United States Patent 11,446,398 (REGULATED BIOCIRCUIT SYSTEMS) - sequence listing, part 2

SEQ ID NO: 714 - protein, 503 aa, Homo sapiens
  Payload ID: 122;
  Gene Symbol: ADCK4;
  Gene Name: aarF domain containing kinase 4;
  Uniprot ID:  Q96D53;
  ENSP ID: ENSP00000243583
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 715 - protein, 544 aa, Homo sapiens
  Payload ID: 122;
  Gene Symbol: ADCK4;
  Gene Name: aarF domain containing kinase 4;
  Uniprot ID:  Q96D53;
  ENSP ID: ENSP00000315118
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSEGGSGLDSSPFLSEANAERIVQTLCTVRGAALKVGQMLSIQDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 716 - protein, 149 aa, Homo sapiens
  Payload ID: 122;
  Gene Symbol: ADCK4;
  Gene Name: aarF domain containing kinase 4;
  ENSP ID: ENSP00000470876
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSEGGSGLDSSPFLSEANAERIVQTLCTV

SEQ ID NO: 717 - protein, 204 aa, Homo sapiens
  Payload ID: 122;
  Gene Symbol: ADCK4;
  Gene Name: aarF domain containing kinase 4;
  ENSP ID: ENSP00000470894
MAKKSMPGGRLQSEGGSGLDSSPFLSEANAERIVQTLCTVRGAALKVGQMLSIQDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVV

SEQ ID NO: 718 - protein, 230 aa, Homo sapiens
  Payload ID: 122;
  Gene Symbol: ADCK4;
  Gene Name: aarF domain containing kinase 4;
  ENSP ID: ENSP00000470916
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSEGGSGLDSSPFLSEANAERIVQTLCTVRGAALKVGQMLSIQDNSFISPQLQHIFERVRQSADFMPRWQMLRVLEEELGRDWQAKVASLEEVPFAAASIGQVHQGLLRD

SEQ ID NO: 719 - protein, 115 aa, Homo sapiens
  Payload ID: 122;
  Gene Symbol: ADCK4;
  Gene Name: aarF domain containing kinase 4;
  ENSP ID: ENSP00000471192
MWLKVGGLLRGTGGQLGQTVGWPCGALGPGPHRWGPCGGSWAQKFYQDGPGRGLGEEDIRRAREARPRKTPRPQLSDRSRERKTTASSALSCSTSLSGSARAPTSCPAGRCCTPA

SEQ ID NO: 720 - protein, 134 aa, Homo sapiens
  Payload ID: 122;
  Gene Symbol: ADCK4;
  Gene Name: aarF domain containing kinase 4;
  ENSP ID: ENSP00000471310
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGEGGSGLDSSPFLSEANAERIVQTLCTVRGAALKVGQML

SEQ ID NO: 721 - protein, 81 aa, Homo sapiens
  Payload ID: 122;
  Gene Symbol: ADCK4;
  Gene Name: aarF domain containing kinase 4;
  ENSP ID: ENSP00000472519
MWLKVGGLLRGTGGQLGQTVGWPCGALGPGPHRWGPCGGSWAQKFYQDGPGRGLGEEDIRRAREARPRKTPRPQTLSPFPS

SEQ ID NO: 722 - protein, 10 aa, Homo sapiens
  Payload ID: 122;
  Gene Symbol: ADCK4;
  Gene Name: aarF domain containing kinase 4;
  ENSP ID: ENSP00000472775
MWLKVGGLLR

SEQ ID NO: 723 - protein, 110 aa, Homo sapiens
  Payload ID: 122;
  Gene Symbol: ADCK4;
  Gene Name: aarF domain containing kinase 4;
  ENSP ID: ENSP00000472925
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEM

SEQ ID NO: 724 - protein, 121 aa, Homo sapiens
  Payload ID: 122;
  Gene Symbol: ADCK4;
  Gene Name: aarF domain containing kinase 4;
  ENSP ID: ENSP00000472978
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQ

SEQ ID NO: 725 - protein, 73 aa, Homo sapiens
  Payload ID: 122;
  Gene Symbol: ADCK4;
  Gene Name: aarF domain containing kinase 4;
  ENSP ID: ENSP00000473017
MAKKSMPGGRLQSEGGSGLDSSPFLSEANAERIVQTLCTVRGAALKVGQMLSIQASSALSCSTSLSGSARAPT

SEQ ID NO: 726 - protein, 157 aa, Homo sapiens
  Payload ID: 122;
  Gene Symbol: ADCK4;
  Gene Name: aarF domain containing kinase 4;
  ENSP ID: ENSP00000473189
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSEGGSGLDSSPFLSEANAERIVQTLCTVRGAALKVG

SEQ ID NO: 727 - protein, 580 aa, Homo sapiens
  Payload ID: 123;
  Gene Symbol: ADCK5;
  Gene Name: aarF domain containing kinase 5;
  Uniprot ID:  Q3MIX3;
  ENSP ID: ENSP00000310547
MWRPVQLCHFHSALLHSRQKPWPSPAVFFRRNVRGLPPRFSSPTPLWRKVLSTAVVGAPLLLGARYVMAEAREKRRMRLVVDGMGRFGRSLKVGLQISLDYWWCTNVVLRGVEENSPGYLEVMSACHQRAADALVAGAISNGGLYVKLGQGLCSFNHLLPPEYTRTLRVLEDRALKRGFQEVDELFLEDFQALPHELFQEFDYQPIAAASLAQVHRAKLHDGTSVAVKVQYIDLRDRFDGDIHTLELLLRLVEVMHPSFGFSWVLQDLKGTLAQELDFENEGRNAERCARELAHFPYVVVPRVHWDKSSKRVLTADFCAGCKVNDVEAIRSQGLAVHDIAEKLIKAFAEQIFYTGFIHSDPHPGNVLVRKGPDGKAELVLLDHGLYQFLEEKDRAALCQLWRAIILRDDAAMRAHAAALGVQDYLLFAEMLMQRPVRLGQLWGSHLLSREEAAYMVDMARERFEAVMAVLRELPRPMLLVLRNINTVRAINVALGAPVDRYFLMAKRAVRGWSRLAGATYRGVYGTSLLRHAKVVWEMLKFEVALRLETLAMRLTALLARALVHLSLVPPAEELYQYLET

SEQ ID NO: 728 - protein, 129 aa, Homo sapiens
  Payload ID: 123;
  Gene Symbol: ADCK5;
  Gene Name: aarF domain containing kinase 5;
  ENSP ID: ENSP00000431875
MWRPVQLCHFHSALLHSRQKPWPSPAVFFRRNVRGLPPRFSSPTPLWRKVLSTAVVGAPLLLGARYVMAEAREKRRMRLVVDGMGRFGRSLKVGLQISLDYWWCTNVVLRGVEEPRLLGGDVCVSPAGG

SEQ ID NO: 729 - protein, 115 aa, Homo sapiens
  Payload ID: 123;
  Gene Symbol: ADCK5;
  Gene Name: aarF domain containing kinase 5;
  ENSP ID: ENSP00000436484
MWRPVQLCHFHSALLHSRQKPWPSPAVFFRRNVRGLPPRFSSPTPLWRKVLSTAVVGAPLLLGARYVMAEAREKRRMRLVVDGMGRFGRPCLPRPWRPTLLVSSSLPSGPQAAGL

SEQ ID NO: 730 - protein, 87 aa, Homo sapiens
  Payload ID: 123;
  Gene Symbol: ADCK5;
  Gene Name: aarF domain containing kinase 5;
  ENSP ID: ENSP00000473494
MWRPAGVQCLNLGSLQSPPTKIKRFSCLSLPTTWDYRCSSVISTLLCCTAGRSPGRPLLCSSGETSGAFLQGSPAPHPCGGRCSPPR

SEQ ID NO: 731 - protein, 1196 aa, Homo sapiens
  Payload ID: 124;
  Gene Symbol: AHI1;
  Gene Name: Abelson helper integration site 1;
  Uniprot ID:  Q8N157;
  ENSP ID: ENSP00000265602
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKQSINKNKSQDFRLGSESMTHSEMRKEQSHEDQGHIMDTRMRKNKQAGRKVTLIE

SEQ ID NO: 732 - protein, 1053 aa, Homo sapiens
  Payload ID: 124;
  Gene Symbol: AHI1;
  Gene Name: Abelson helper integration site 1;
  Uniprot ID:  Q8N157;
  ENSP ID: ENSP00000322478
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTDSHFAEFNTCILWWKKH

SEQ ID NO: 733 - protein, 668 aa, Homo sapiens
  Payload ID: 124;
  Gene Symbol: AHI1;
  Gene Name: Abelson helper integration site 1;
  ENSP ID: ENSP00000356773
  MOD_RES (1)..(1): Any amino acid
XPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKQSINKNKSQDFRLGSESMTHKELKKS

SEQ ID NO: 734 - protein, 1196 aa, Homo sapiens; identical to SEQ ID NO: 731
  Payload ID: 124;
  Gene Symbol: AHI1;
  Gene Name: Abelson helper integration site 1;
  Uniprot ID:  Q8N157;
  ENSP ID: ENSP00000356774

SEQ ID NO: 735 - protein, 1196 aa, Homo sapiens; identical to SEQ ID NO: 731
  Payload ID: 124;
  Gene Symbol: AHI1;
  Gene Name: Abelson helper integration site 1;
  Uniprot ID:  Q8N157;
  ENSP ID: ENSP00000388650

SEQ ID NO: 736 - protein, 609 aa, Homo sapiens
  Payload ID: 124;
  Gene Symbol: AHI1;
  Gene Name: Abelson helper integration site 1;
  Uniprot ID:  Q8N157;
  ENSP ID: ENSP00000432167
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQENEDVFVLISPTMEEY

SEQ ID NO: 737 - protein, 54 aa, Homo sapiens
  Payload ID: 124;
  Gene Symbol: AHI1;
  Gene Name: Abelson helper integration site 1;
  ENSP ID: ENSP00000433017
MPTAESEAKVKTKVRFEELLKTHSDLMREKKKLKKKLVRSEENISNQEKSMAVW

SEQ ID NO: 738 - protein, 288 aa, Homo sapiens
  Payload ID: 124;
  Gene Symbol: AHI1;
  Gene Name: Abelson helper integration site 1;
  ENSP ID: ENSP00000433063
MPTAESEAKVKTKVRFEELLKTHSDLMREKKKLKKKLVRSEENISPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKK

SEQ ID NO: 739 - protein, 29 aa, Homo sapiens
  Payload ID: 124;
  Gene Symbol: AHI1;
  Gene Name: Abelson helper integration site 1;
  ENSP ID: ENSP00000433864
  MOD_RES (1)..(1): Any amino acid
XDFRLGSESMTQRELNEKAGGICIAREGL

SEQ ID NO: 740 - protein, 129 aa, Homo sapiens
  Payload ID: 124;
  Gene Symbol: AHI1;
  Gene Name: Abelson helper integration site 1;
  ENSP ID: ENSP00000434697
  MOD_RES (1)..(1): Any amino acid
XGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGEPLSYFDNSFKCSDACCVDEYHLFL

SEQ ID NO: 741 - protein, 542 aa, Homo sapiens
  Payload ID: 124;
  Gene Symbol: AHI1;
  Gene Name: Abelson helper integration site 1;
  ENSP ID: ENSP00000435710
  MOD_RES (1)..(1): Any amino acid
XSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKVK

SEQ ID NO: 742 - protein, 48 aa, Homo sapiens
  Payload ID: 124;
  Gene Symbol: AHI1;
  Gene Name: Abelson helper integration site 1;
  ENSP ID: ENSP00000436071
MPTAESEAKVKTKVRFEELLKTHSDLMREKKKLKKKLVRSEENISVSK

SEQ ID NO: 743 - protein, 48 aa, Homo sapiens; identical to SEQ ID NO: 742
  Payload ID: 124;
  Gene Symbol: AHI1;
  Gene Name: Abelson helper integration site 1;
  ENSP ID: ENSP00000436516

SEQ ID NO: 744 - protein, 167 aa, Homo sapiens
  Payload ID: 125;
  Gene Symbol: ABHD14A-ACY1;
  Gene Name: ABHD14A-ACY1 readthrough;
  ENSP ID: ENSP00000417688
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPAHHAQRHDQQGSRGGAPIGDALPPVPAYPHCPAQA

SEQ ID NO: 745 - protein, 167 aa, Homo sapiens; identical to SEQ ID NO: 744
  Payload ID: 125;
  Gene Symbol: ABHD14A-ACY1;
  Gene Name: ABHD14A-ACY1 readthrough;
  ENSP ID: ENSP00000420395

SEQ ID NO: 746 - protein, 509 aa, Homo sapiens
  Payload ID: 125;
  Gene Symbol: ABHD14A-ACY1;
  Gene Name: ABHD14A-ACY1 readthrough;
  ENSP ID: ENSP00000420487
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 747 - protein, 405 aa, Homo sapiens
  Payload ID: 126;
  Gene Symbol: ABHD1;
  Gene Name: abhydrolase domain containing 1;
  Uniprot ID:  Q96SE0;
  ENSP ID: ENSP00000326491
MLSSFLSPQNGTWADTFSLLLALAVALYLGYYWACVLQRPRLVAGPQFLAFLEPHCSITTETFYPTLWCFEGRLQSIFQVLLQSQPLVLYQSDILQTPDGGQLLLDWAKQPDSSQDPDPTTQPIVLLLPGITGSSQETYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLTAGLCQLVERNRKVIEKVVDIDFVLQARTIRQFDERYTSVAFGYQDCVTYYKAASPRTKIDAIRIPVLYLSAADDPFSPVCALPIQAAQHSPYVALLITARGGHIGFLEGLLPWQHWYMSRLLHQYAKAIFQDPEGLPDLRALLPSEDRNS

SEQ ID NO: 748 - protein, 102 aa, Homo sapiens
  Payload ID: 126;
  Gene Symbol: ABHD1;
  Gene Name: abhydrolase domain containing 1;
  ENSP ID: ENSP00000390390
MAPGQTPSLCSWLLPLPSTWATTGHVCFSDILQTPDGGQLLLDWAKQPDSSQDPDPTTQPIVLLLPGITGSSQETYVLHLVNQALRDGYQPTGLFVPAILKI

SEQ ID NO: 749 - protein, 177 aa, Homo sapiens
  Payload ID: 126;
  Gene Symbol: ABHD1;
  Gene Name: abhydrolase domain containing 1;
  ENSP ID: ENSP00000397522
MAPGQTPSLCSWLLPLPSTWATTGHVCFSDILQTPDGGQLLLDWAKQPDSSQDPDPTTQPIVLLLPGITGSSQETYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRS

SEQ ID NO: 750 - protein, 305 aa, Homo sapiens
  Payload ID: 126;
  Gene Symbol: ABHD1;
  Gene Name: abhydrolase domain containing 1;
  Uniprot ID:  Q96SE0;
  ENSP ID: ENSP00000410756
MLSSFLSPQNGTWADTFSLLLALAVALYLGYYWACVLQRPRLVAGPQFLAFLEPHCSITTETFYPTLWCFEGRLQSIFQVLLQSQPLVLYQSDILQTPDGGQLLLDWAKQPDSSQDPDPTTQPIVLLLPGITGSSQETYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLTAGLCQLVERLSYGKTCRPVQSASLMSATHLWPLDIKTVLPTTKQQALEPR

SEQ ID NO: 751 - protein, 305 aa, Homo sapiens; identical to SEQ ID NO: 750
  Payload ID: 126;
  Gene Symbol: ABHD1;
  Gene Name: abhydrolase domain containing 1;
  Uniprot ID:  Q96SE0;
  ENSP ID: ENSP00000481238

SEQ ID NO: 752 - protein, 306 aa, Homo sapiens
  Payload ID: 127;
  Gene Symbol: ABHD10;
  Gene Name: abhydrolase domain containing 10;
  Uniprot ID:  Q9NUJ1;
  ENSP ID: ENSP00000273359
MAVARLAAVAAWVPCRSWGWAAVPFGPHRGLSVLLARIPQRAPRWLPACRQKTSLSFLNRPDLPNLAYKKLKGKSPGIIFIPGYLSYMNGTKALAIEEFCKSLGHACIRFDYSGVGSSDGNSEESTLGKWRKDVLSIIDDLADGPQILVGSSLGGWLMLHAAIARPEKVVALIGVATAADTLVTKFNQLPVELKKEVEMKGVWSMPSKYSEEGVYNVQYSFIKEAEHHCLLHSPIPVNCPIRLLHGMKDDIVPWHTSMQVADRVLSTDVDVILRKHSDHRMREKADIQLLVYTIDDLIDKLSTIVN

SEQ ID NO: 753 - protein, 52 aa, Homo sapiens
  Payload ID: 127;
  Gene Symbol: ABHD10;
  Gene Name: abhydrolase domain containing 10;
  ENSP ID: ENSP00000417880
MAVARLAAVAAWVPCRSWGWAAVPFGPHRGLSVLLARIPQRAPRWLPDSCWI

SEQ ID NO: 754 - protein, 75 aa, Homo sapiens
  Payload ID: 127;
  Gene Symbol: ABHD10;
  Gene Name: abhydrolase domain containing 10;
  ENSP ID: ENSP00000418162
MAVARLAAVAAWVPCRSWGWAAVPFGPHRGLSVLLARIPQRAPRWLPGLITQELEVQMVTQRKAHWGNGEKMFFL

SEQ ID NO: 755 - protein, 205 aa, Homo sapiens
  Payload ID: 127;
  Gene Symbol: ABHD10;
  Gene Name: abhydrolase domain containing 10;
  Uniprot ID:  Q9NUJ1;
  ENSP ID: ENSP00000418973
MAVARLAAVAAWVPCRSWGWAAVPFGPHRGLSVLLARIPQRAPRWLPACRQKTSLSFLNRPDLPNLAYKKLKGKSPGIIFIPGYLSYMNGTKALAIEEFCKSLGHACIRFDYSGVGSSDGNSEESTLGKWRKDVLSIIDDLADGPQILVGSSLGGWLMLHAAIARPEKVVALIGVATAADTLVTKFNQLPVEDSGRKNYISLHSA

SEQ ID NO: 756 - protein, 315 aa, Homo sapiens
  Payload ID: 128;
  Gene Symbol: ABHD11;
  Gene Name: abhydrolase domain containing 11;
  Uniprot ID:  Q8NFV4;
  ENSP ID: ENSP00000222800
MRAGQQLASMLRWTRAWRLPREGLGPHGPSFARVPVAPSSSSGGRGGAEPRPLPLSYRLLDGEAALPAVVFLHGLFGSKTNFNSIAKILAQQTGRRVLTVDARNHGDSPHSPDMSYEIMSQDLQDLLPQLGLVPCVVVGHSMGGKTAMLLALQRPELVERLIAVDISPVESTGVSHFATYVAAMRAINIADELPRSRARKLADEQLSSVIQDMAVRQHLLTNLVEVDGRFVWRVNLDALTQHLDKILAFPQRQESYLGPTLFLLGGNSQFVHPSHHPEIMRLFPRAQMQTVPNAGHWIHADRPQDFIAAIRGFLV

SEQ ID NO: 757 - protein, 258 aa, Homo sapiens
  Payload ID: 128;
  Gene Symbol: ABHD11;
  Gene Name: abhydrolase domain containing 11;
  Uniprot ID:  Q8NFV4;
  ENSP ID: ENSP00000378579
MRAGQQLASMLRWTRAWRLPREGLGPHGPSFARVPVAPSSSSGGRGGAEPRPLPLSYRLLDGEAALPAVVFLHGLFGSKTNFNSIAKILAQQTGRRVLTVDARNHGDSPHSPDMSYEIMSQDLQDLLPQLGLVPCVVVGHSMGGKTAMLLALQRDMAVRQHLLTNLVEVDGRFVWRVNLDALTQHLDKILAFPQRQESYLGPTLFLLGGNSQFVHPSHHPEIMRLFPRAQMQTVPNAGHWIHADRPQDFIAAIRGFLV

SEQ ID NO: 758 - protein, 184 aa, Homo sapiens
  Payload ID: 128;
  Gene Symbol: ABHD11;
  Gene Name: abhydrolase domain containing 11;
  ENSP ID: ENSP00000387908
  MOD_RES (1)..(1): Any amino acid
XREGLGPHGPSFARVPVAPSSSSGGRGGAEPRPLPLSYRLLDGEAALPAVVFLHGLFGSKTNFNSIAKILAQQTGRRVLTVDARNHGDSPHSPDMSYEIMSQDLQDLLPQLGLVPCVVVGHSMGGKTAMLLALQRVIHPRCPGWYCRPGPVKGRVAPPDRTRNLPQLLHPHRTWPCGSTCSLTW

SEQ ID NO: 759 - protein, 101 aa, Homo sapiens
  Payload ID: 128;
  Gene Symbol: ABHD11;
  Gene Name: abhydrolase domain containing 11;
  Uniprot ID:  Q8NFV4;
  ENSP ID: ENSP00000392945
MRAGQQLASMLRWTRAWRLPREGLGPHGPSFARVPVAPSSSSGGRGGAEPRPLPLSYRLLDGEAALPAVVFLHGLFGSKTNFNSIAKILAQQTGRADGGCS

SEQ ID NO: 760 - protein, 159 aa, Homo sapiens
  Payload ID: 128;
  Gene Symbol: ABHD11;
  Gene Name: abhydrolase domain containing 11;
  ENSP ID: ENSP00000397666
MRAGQQLASMLRWTRAWRLPREGLGPHGPSFARVPVAPSSSSGGRGGAEPRPLPLSYRLLDGEAALPAVVFLHGLFGSKTNFNSIAKILAQQTGRRVLTVDARNHGDSPHSPDMSYEIMSQDLQDLLPQLGLVPCVVVGHSMGGKTAMLLALQRSQPPP

SEQ ID NO: 761 - protein, 123 aa, Homo sapiens
  Payload ID: 128;
  Gene Symbol: ABHD11;
  Gene Name: abhydrolase domain containing 11;
  ENSP ID: ENSP00000410536
  MOD_RES (1)..(1): Any amino acid
XPLPLSYRLLDGEAALPAVVFLHGLFGSKTNFNSIAKILAQQTGRRVLTVDARNHGDSPHSPDMSYEIMSQDLQDLLPQLGLVPCVVVGHSMGGKTAMLLALQRISAQWKAQVSPTLQPMWQP

SEQ ID NO: 762 - protein, 308 aa, Homo sapiens
  Payload ID: 128;
  Gene Symbol: ABHD11;
  Gene Name: abhydrolase domain containing 11;
  Uniprot ID:  Q8NFV4;
  ENSP ID: ENSP00000416970
MRAGQQLASMLRWTRAWRLPREGLGPHGPSFARVPVAPSSSSGGRGGAEPRLLDGEAALPAVVFLHGLFGSKTNFNSIAKILAQQTGRRVLTVDARNHGDSPHSPDMSYEIMSQDLQDLLPQLGLVPCVVVGHSMGGKTAMLLALQRPELVERLIAVDISPVESTGVSHFATYVAAMRAINIADELPRSRARKLADEQLSSVIQDMAVRQHLLTNLVEVDGRFVWRVNLDALTQHLDKILAFPQRQESYLGPTLFLLGGNSQFVHPSHHPEIMRLFPRAQMQTVPNAGHWIHADRPQDFIAAIRGFLV

SEQ ID NO: 763 - protein, 87 aa, Homo sapiens
  Payload ID: 128;
  Gene Symbol: ABHD11;
  Gene Name: abhydrolase domain containing 11;
  ENSP ID: ENSP00000430937
LRWTRAWRLPREGLGPHGPSFARVPVAPSSSSGGRGGAEPRPLPLSYRLLDGEAALPAVVFLHGLFGSKTNFNSIAKILAQQTGRRG

SEQ ID NO: 764 - protein, 398 aa, Homo sapiens
  Payload ID: 129;
  Gene Symbol: ABHD12;
  Gene Name: abhydrolase domain containing 12;
  Uniprot ID:  Q8N2K0;
  ENSP ID: ENSP00000341408
MRKRTEPVALEHERCAAAGSSSSGSAAAALDADCRLKQNLRLTGPAAAEPRCAADAGMKRALGRRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILREFLGKSEPEHQH

SEQ ID NO: 765 - protein, 404 aa, Homo sapiens
  Payload ID: 129;
  Gene Symbol: ABHD12;
  Gene Name: abhydrolase domain containing 12;
  Uniprot ID:  Q8N2K0;
  ENSP ID: ENSP00000365725
MRKRTEPVALEHERCAAAGSSSSGSAAAALDADCRLKQNLRLTGPAAAEPRCAADAGMKRALGRRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILRPQQGPGSSPDPSMWSELV

SEQ ID NO: 766 - protein, 187 aa, Homo sapiens
  Payload ID: 129;
  Gene Symbol: ABHD12;
  Gene Name: abhydrolase domain containing 12;
  ENSP ID: ENSP00000413311
MSGGGHGGVCFLCCILLQGRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIK

SEQ ID NO: 767 - protein, 194 aa, Homo sapiens
  Payload ID: 129;
  Gene Symbol: ABHD12;
  Gene Name: abhydrolase domain containing 12;
  ENSP ID: ENSP00000459121
ARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKVGPGLCLWCSWHLAHSASVGGPGWEWAGGKAAPACCITGCAPATSGSGGHLILPASPPGCFGRTWEVWCKGWGRGPLMLSPRI

SEQ ID NO: 768 - protein, 13 aa, Homo sapiens
  Payload ID: 129;
  Gene Symbol: ABHD12;
  Gene Name: abhydrolase domain containing 12;
  ENSP ID: ENSP00000459278
  MOD_RES (1)..(1): Any amino acid
XEFLGKSEPEHQH

SEQ ID NO: 769 - protein, 159 aa, Homo sapiens
  Payload ID: 129;
  Gene Symbol: ABHD12;
  Gene Name: abhydrolase domain containing 12;
  ENSP ID: ENSP00000459495
MWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDE

SEQ ID NO: 770 - protein, 118 aa, Homo sapiens
  Payload ID: 129;
  Gene Symbol: ABHD12;
  Gene Name: abhydrolase domain containing 12;
  ENSP ID: ENSP00000460249
MRKRTEPVALEHERCAAAGSSSSGSAAAALDADCRLKQNLRLTGPAAAEPRCAADAGMKRALGRRKGVWLRLRKILFCVLGLYIAIPFLIKLCPGIQAKLIFLNFGPCAPSQLEDFLC

SEQ ID NO: 771 - protein, 105 aa, Homo sapiens
  Payload ID: 129;
  Gene Symbol: ABHD12;
  Gene Name: abhydrolase domain containing 12;
  ENSP ID: ENSP00000460950
MWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCER

SEQ ID NO: 772 - protein, 362 aa, Homo sapiens
  Payload ID: 130;
  Gene Symbol: ABHD12B;
  Gene Name: abhydrolase domain containing 12B;
  Uniprot ID:  Q7Z5M8;
  ENSP ID: ENSP00000336693
MDAQDCQAAASPEPPGPPARSCVAAWWDMVDRNLRYFPHSCSMLGRKIAALYDSFTSKSLKEHVFLPLIDMLIYFNFFKAPFLVDLKKPELKIPHTVNFYLRVEPGVMLGIWHTVPSCRGEDAKGKDCCWYEAALRDGNPIIVYLHGSAEHRAASHRLKLVKVLSDGGFHVLSVDYRGFGDSTGKPTEEGLTTDAICVYEWTKARSGITPVCLWGHSLGTGVATNAAKVLEEKGCPVDAIVLEAPFTNMWVASINYPLLKIYRNIPGFLRTLMDALRKDKIIFPNDENVKFLSSPLLILHGEDDRTVPLEYGKKLYEIARNAYRNKERVKMVIFPPGFQHNLLCKSPTLLITVRDFLSKQWS

SEQ ID NO: 773 - protein, 285 aa, Homo sapiens
  Payload ID: 130;
  Gene Symbol: ABHD12B;
  Gene Name: abhydrolase domain containing 12B;
  Uniprot ID:  Q7Z5M8;
  ENSP ID: ENSP00000343951
MDAQDCQAAASPEPPGPPARSCVAAWWDMVDRNLRHTVPSCRGEDAKGKDCCWYEAALRDGNPIIVYLHGSAEHRAASHRLKLVKVLSDGGFHVLSVDYRGFGDSTGKPTEEGLTTDAICVYEWTKARSGITPVCLWGHSLGTGVATNAAKVLEEKGCPVDAIVLEAPFTNMWVASINYPLLKIYRNIPGFLRTLMDALRKDKIIFPNDENVKFLSSPLLILHGEDDRTVPLEYGKKLYEIARNAYRNKERVKMVIFPPGFQHNLLCKSPTLLITVRDFLSKQWS

SEQ ID NO: 774 - protein, 60 aa, Homo sapiens
  Payload ID: 130;
  Gene Symbol: ABHD12B;
  Gene Name: abhydrolase domain containing 12B;
  Uniprot ID:  Q7Z5M8;
  ENSP ID: ENSP00000371460
MDAQDCQAAASPEPPGPPARSCVAAWWDMVDRNLRQSPISCGFKETRVKDSSHSELLPES

SEQ ID NO: 775 - protein, 60 aa, Homo sapiens; identical to SEQ ID NO: 774
  Payload ID: 130;
  Gene Symbol: ABHD12B;
  Gene Name: abhydrolase domain containing 12B;
  Uniprot ID:  Q7Z5M8;
  ENSP ID: ENSP00000450643

SEQ ID NO: 776 - protein, 337 aa, Homo sapiens
  Payload ID: 131;
  Gene Symbol: ABHD13;
  Gene Name: abhydrolase domain containing 13;
  Uniprot ID:  Q7L211;
  ENSP ID: ENSP00000365063
MEKSWMLWNFVERWLIALASWSWALCRISLLPLIVTFHLYGGIILLLLIFISIAGILYKFQDVLLYFPEQPSSSRLYVPMPTGIPHENIFIRTKDGIRLNLILIRYTGDNSPYSPTIIYFHGNAGNIGHRLPNALLMLVNLKVNLLLVDYRGYGKSEGEASEEGLYLDSEAVLDYVMTRPDLDKTKIFLFGRSLGGAVAIHLASENSHRISAIMVENTFLSIPHMASTLFSFFPMRYLPLWCYKNKFLSYRKISQCRMPSLFISGLSDQLIPPVMMKQLYELSPSRTKRLAIFPDGTHNDTWQCQGYFTALEQFIKEVVKSHSPEEMAKTSSNVTII

SEQ ID NO: 777 - protein, 271 aa, Homo sapiens
  Payload ID: 132;
  Gene Symbol: ABHD14A;
  Gene Name: abhydrolase domain containing 14A;
  Uniprot ID:  Q9BUJ0;
  ENSP ID: ENSP00000273596
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPGFGNSAPSKEASTEAGRAALLERALRDLEVQNAVLVSPSLSGHYALPFLMRGHHQLHGFVPIAPTSTQNYTQEQFWAVKTPTLILYGELDHILARESLRQLRHLPNHSVVKLRNAGHACYLHKPQDFHLVLLAFLDHLP

SEQ ID NO: 778 - protein, 229 aa, Homo sapiens [sequence omitted]

SEQ ID NO: 779 - protein, 224 aa, Homo sapiens
  Payload ID: 132;
  Gene Symbol: ABHD14A;
  Gene Name: abhydrolase domain containing 14A;
  ENSP ID: ENSP00000418242
MQQQYREASLPTAGQGLSEEEGLALHLDGALALLHACCHACCCCAGEGPVVQNHDDEGPQNTLPRVAVPEEQQGSLQEVSRTLRTCLGTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPGFGNSAPSKEASTEAGRAALLERALRD

SEQ ID NO: 780 - protein, 124 aa, Homo sapiens
  Payload ID: 132;
  Gene Symbol: ABHD14A;
  Gene Name: abhydrolase domain containing 14A;
  ENSP ID: ENSP00000418824
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRLQPLSCMESWTTSWLESHCGSSATCPTTLW

SEQ ID NO: 781 - protein, 152 aa, Homo sapiens
  Payload ID: 132;
  Gene Symbol: ABHD14A;
  Gene Name: abhydrolase domain containing 14A;
  ENSP ID: ENSP00000420475
MVATPKEGTQGSEKGRLGTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPGFGNSAPSKEASTEAGRAALLERAL

SEQ ID NO: 782 - protein, 208 aa, Homo sapiens
  Payload ID: 133;
  Gene Symbol: ABHD14B;
  Gene Name: abhydrolase domain containing 14B;
  ENSP ID: ENSP00000318248
MAASVEQREGTIQVQGQALFFREALPGSGQARFSVLLLHGIRFSSETWQNLGTLHRLAQAGYRAVAIDLPGLKGEPPAQEPLLSQSRASFLAAVVDALELGPPVVISPSLSGMYSLPFLTAPGSQLPGFVPVAPICTDKINAANYASVKTPALIVYGDQDPMGQTSFEHLKQLPNHRVLIMKGAGHPCYLDKPEEWHTGLLDFLQGLQ

SEQ ID NO: 783 - protein, 210 aa, Homo sapiens
  Payload ID: 133;
  Gene Symbol: ABHD14B;
  Gene Name: abhydrolase domain containing 14B;
  Uniprot ID:  Q96IU4;
  ENSP ID: ENSP00000354841
MAASVEQREGTIQVQGQALFFREALPGSGQARFSVLLLHGIRFSSETWQNLGTLHRLAQAGYRAVAIDLPGLGHSKEAAAPAPIGELAPGSFLAAVVDALELGPPVVISPSLSGMYSLPFLTAPGSQLPGFVPVAPICTDKINAANYASVKTPALIVYGDQDPMGQTSFEHLKQLPNHRVLIMKGAGHPCYLDKPEEWHTGLLDFLQGLQ

SEQ ID NO: 784 - protein, 210 aa, Homo sapiens; identical to SEQ ID NO: 783
  Payload ID: 133;
  Gene Symbol: ABHD14B;
  Gene Name: abhydrolase domain containing 14B;
  Uniprot ID:  Q96IU4;
  ENSP ID: ENSP00000378455

SEQ ID NO: 785 - protein, 188 aa, Homo sapiens
  Payload ID: 133;
  Gene Symbol: ABHD14B;
  Gene Name: abhydrolase domain containing 14B;
  ENSP ID: ENSP00000417564
MAASVEQREGTIQVQGQALFFREALPGSGQARFSVLLLHGIRFSSETWQNLGTLHRLAQAGYRAVAIDLPGLGHSKEAAAPAPIGELAPGSFLAAVVDALELGPPVVISPSLSGMYSLPFLTAPGSQLPGFVPVAPICTDKINAANYASVKVPLCGKLRCPCQEQGRVHPWAFLIWGLDNQGVSSGRS

SEQ ID NO: 786 - protein, 210 aa, Homo sapiens; identical to SEQ ID NO: 783
  Payload ID: 133;
  Gene Symbol: ABHD14B;
  Gene Name: abhydrolase domain containing 14B;
  Uniprot ID:  Q96IU4;
  ENSP ID: ENSP00000420065

SEQ ID NO: 787 - protein, 210 aa, Homo sapiens; identical to SEQ ID NO: 783
  Payload ID: 133;
  Gene Symbol: ABHD14B;
  Gene Name: abhydrolase domain containing 14B;
  Uniprot ID:  Q96IU4;
  ENSP ID: ENSP00000433388

SEQ ID NO: 788 - protein, 468 aa, Homo sapiens
  Payload ID: 134;
  Gene Symbol: ABHD15;
  Gene Name: abhydrolase domain containing 15;
  Uniprot ID:  Q6UXT9;
  ENSP ID: ENSP00000302657
MPPWGAALALILAVLALLGLLGPRLRGPWGRAVGERTLPGAQDRDDGEEADGGGPADQFSDGREPLPGGCSLVCKPSALAQCLLRALRRSEALEAGPRSWFSGPHLQTLCHFVLPVAPGPELAREYLQLADDGLVALDWVVGPCVRGRRITSAGGLPAVLLVIPNAWGRLTRNVLGLCLLALERGYYPVIFHRRGHHGCPLVSPRLQPFGDPSDLKEAVTYIRFRHPAAPLFAVSEGSGSALLLSYLGECGSSSYVTGAACISPVLRCREWFEAGLPWPYERGFLLHQKIALSRYATALEDTVDTSRLFRSRSLREFEEALFCHTKSFPISWDTYWDRNDPLRDVDEAAVPVLCICSADDPVCGPPDHTLTTELFHSNPYFFLLLSRHGGHCGFLRQEPLPAWSHEVILESFRALTEFFRTEERIKGLSRHRASFLGGRRRGGALQRREVSSSSNLEEIFNWKRSYTR

SEQ ID NO: 789 - protein, 558 aa, Homo sapiens
  Payload ID: 135;
  Gene Symbol: ABHD16A;
  Gene Name: abhydrolase domain containing 16A;
  Uniprot ID:  O95870;
  ENSP ID: ENSP00000379282
MAKLLSCVLGPRLYKIYRERDSERAPASVPETPTAVTAPHSSSWDTYYQPRALEKHADSILALASVFWSISYYSSPFAFFYLYRKGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRLGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 790 - protein, 263 aa, Homo sapiens
  Payload ID: 135;
  Gene Symbol: ABHD16A;
  Gene Name: abhydrolase domain containing 16A;
  ENSP ID: ENSP00000388346
MPPPALFLSSLYPRLEFQNDFYRSCIRRSSPQPPPNLAWRPESLYSGELAGGGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGC

SEQ ID NO: 791 - protein, 601 aa, Homo sapiens
  Payload ID: 135;
  Gene Symbol: ABHD16A;
  Gene Name: abhydrolase domain containing 16A;
  ENSP ID: ENSP00000389155
MSQLARRRSRYGLTSRAHNTSEAGRAGPAGGPAAGRAAARAGAMAKLLSCVLGPRLYKIYRERDSERAPASVPETPTAVTAPHSSSWDTYYQPRALEKHADSILALASVFWSISYYSSPFAFFYLYRKGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRLGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 792 - protein, 263 aa, Homo sapiens; identical to SEQ ID NO: 790
  Payload ID: 135;
  Gene Symbol: ABHD16A;
  Gene Name: abhydrolase domain containing 16A;
  ENSP ID: ENSP00000393632

SEQ ID NO: 793 - protein, 263 aa, Homo sapiens; identical to SEQ ID NO: 790
  Payload ID: 135;
  Gene Symbol: ABHD16A;
  Gene Name: abhydrolase domain containing 16A;
  ENSP ID: ENSP00000394825

SEQ ID NO: 794 - protein, 558 aa, Homo sapiens; identical to SEQ ID NO: 789
  Payload ID: 135;
  Gene Symbol: ABHD16A;
  Gene Name: abhydrolase domain containing 16A;
  Uniprot ID:  O95870;
  ENSP ID: ENSP00000395665

SEQ ID NO: 795 - protein, 263 aa, Homo sapiens; identical to SEQ ID NO: 790
  Payload ID: 135;
  Gene Symbol: ABHD16A;
  Gene Name: abhydrolase domain containing 16A;
  ENSP ID: ENSP00000396207

SEQ ID NO: 796 - protein, 601 aa, Homo sapiens; identical to SEQ ID NO: 791
  Payload ID: 135;
  Gene Symbol: ABHD16A;
  Gene Name: abhydrolase domain containing 16A;
  ENSP ID: ENSP00000405428

SEQ ID NO: 797 - protein, 601 aa, Homo sapiens; identical to SEQ ID NO: 791
  Payload ID: 135;
  Gene Symbol: ABHD16A;
  Gene Name: abhydrolase domain containing 16A;
  ENSP ID: ENSP00000406965

SEQ ID NO: 798 - protein, 263 aa, Homo sapiens; identical to SEQ ID NO: 790
  Payload ID: 135;
  Gene Symbol: ABHD16A;
  Gene Name: abhydrolase domain containing 16A;
  ENSP ID: ENSP00000407263

SEQ ID NO: 799 - protein, 601 aa, Homo sapiens; identical to SEQ ID NO: 791
  Payload ID: 135;
  Gene Symbol: ABHD16A;
  Gene Name: abhydrolase domain containing 16A;
  ENSP ID: ENSP00000407727

SEQ ID NO: 800 - protein, 525 aa, Homo sapiens
  Payload ID: 135;
  Gene Symbol: ABHD16A;
  Gene Name: abhydrolase domain containing 16A;
  Uniprot ID:  O95870;
  ENSP ID: ENSP00000410347
MPPPALFLSSLYPRLEFQNDFYRSCIRRSSPQPPPNLAWRPESLYSGELAGGGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRLGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 801 - protein, 263 aa, Homo sapiens; identical to SEQ ID NO: 790
  Payload ID: 135;
  Gene Symbol: ABHD16A;
  Gene Name: abhydrolase domain containing 16A;
  ENSP ID: ENSP00000415240

SEQ ID NO: 802 - protein, 601 aa, Homo sapiens; identical to SEQ ID NO: 791
  Payload ID: 135;
  Gene Symbol: ABHD16A;
  Gene Name: abhydrolase domain containing 16A;
  ENSP ID: ENSP00000416404

SEQ ID NO: 803 - protein, 65 aa, Homo sapiens
  Payload ID: 135;
  Gene Symbol: ABHD16A;
  Gene Name: abhydrolase domain containing 16A;
  ENSP ID: ENSP00000417566
MPPPALFLSSLYPRLEFQNDFYRSCIRRSSPQPPPNLAWRPESLYSGELAGGGYVLSAPCPGETC

SEQ ID NO: 804 - protein, 65 aa, Homo sapiens
  Payload ID: 135;
  Gene Symbol: ABHD16A;
  Gene Name: abhydrolase domain containing 16A;
  ENSP ID: ENSP00000418170
MAKLLSCVLGPRLYKIYRERDSERAPASVPETPTAVTAPHSSSWDTYYQPRALEKHADSILALVT

SEQ ID NO: 805 - protein, 46 aa, Homo sapiens
  Payload ID: 135;
  Gene Symbol: ABHD16A;
  Gene Name: abhydrolase domain containing 16A;
  ENSP ID: ENSP00000418331
MAKLLSCVLGPRLYKIYRERDSERAPASVPETPTAVTAPHSSSWVT

SEQ ID NO: 806 - protein, 65 aa, Homo sapiens; identical to SEQ ID NO: 804
  Payload ID: 135;
  Gene Symbol: ABHD16A;
  Gene Name: abhydrolase domain containing 16A;
  ENSP ID: ENSP00000419742

SEQ ID NO: 807 - protein, 65 aa, Homo sapiens; identical to SEQ ID NO: 803
  Payload ID: 135;
  Gene Symbol: ABHD16A;
  Gene Name: abhydrolase domain containing 16A;
  ENSP ID: ENSP00000420585

SEQ ID NO: 808 - protein, 46 aa, Homo sapiens; identical to SEQ ID NO: 805
  Payload ID: 135;
  Gene Symbol: ABHD16A;
  Gene Name: abhydrolase domain containing 16A;
  ENSP ID: ENSP00000420628

SEQ ID NO: 809 - protein, 525 aa, Homo sapiens; identical to SEQ ID NO: 800
  Payload ID: 135;
  Gene Symbol: ABHD16A;
  Gene Name: abhydrolase domain containing 16A;
  Uniprot ID:  O95870;
  ENSP ID: ENSP00000447498

SEQ ID NO: 810 - protein, 525 aa, Homo sapiens; identical to SEQ ID NO: 800
  Payload ID: 135;
  Gene Symbol: ABHD16A;
  Gene Name: abhydrolase domain containing 16A;
  Uniprot ID:  O95870;
  ENSP ID: ENSP00000447549

SEQ ID NO: 811 - protein, 525 aa, Homo sapiens; identical to SEQ ID NO: 800
  Payload ID: 135;
  Gene Symbol: ABHD16A;
  Gene Name: abhydrolase domain containing 16A;
  Uniprot ID:  O95870;
  ENSP ID: ENSP00000447846

SEQ ID NO: 812 - protein, 525 aa, Homo sapiens; identical to SEQ ID NO: 800
  Payload ID: 135;
  Gene Symbol: ABHD16A;
  Gene Name: abhydrolase domain containing 16A;
  Uniprot ID:  O95870;
  ENSP ID: ENSP00000448431

SEQ ID NO: 813 - protein, 525 aa, Homo sapiens; identical to SEQ ID NO: 800
  Payload ID: 135;
  Gene Symbol: ABHD16A;
  Gene Name: abhydrolase domain containing 16A;
  Uniprot ID:  O95870;
  ENSP ID: ENSP00000448451

SEQ ID NO: 814 - protein, 525 aa, Homo sapiens; identical to SEQ ID NO: 800
  Payload ID: 135;
  Gene Symbol: ABHD16A;
  Gene Name: abhydrolase domain containing 16A;
  Uniprot ID:  O95870;
  ENSP ID: ENSP00000449579

SEQ ID NO: 815 - protein, 469 aa, Homo sapiens
  Payload ID: 136;
  Gene Symbol: ABHD16B;
  Gene Name: abhydrolase domain containing 16B;
  Uniprot ID:  Q9H3Z7;
  ENSP ID: ENSP00000358932
MCVICFVKALVRVFKIYLTASYTYPFRGWPVAFRWDDVRAVGRSSSHRALTCAAAAAGVWLLRDETLGGDALGRPPRGARSQAQCLLQQLRELPGQLASYALAHSLGRWLVYPGSVSLMTRALLPLLQQGQERLVERYHGRRAKLVACDGNEIDTMFMDRRQHPGSHVHGPRLVICCEGNAGFYEMGCLSAPLEAGYSVLGWNHPGFGSSTGVPFPQHDANAMDVVVEYALHRLHFPPAHLVVYGWSVGGFTATWATMTYPELGALVLDATFDDLVPLALKVMPHSWKGLVVRTVREHFNLNVAEQLCCYPGPVLLLRRTQDDVVSTSGRLRPLSPGDVEGNRGNELLLRLLEHRYPVVMAREGRAVVTRWLRAGSLAQEAAFYARYRVDEDWCLALLRSYRARCEEELEGEEALGPHGPAFPWLVGQGLSSRRRRRLALFLARKHLKNVEATHFSPLEPEEFQLPWRL

SEQ ID NO: 816 - protein, 361 aa, Homo sapiens
  Payload ID: 137;
  Gene Symbol: ABHD17A;
  Gene Name: abhydrolase domain containing 17A;
  Uniprot ID:  Q96GS6;
  ENSP ID: ENSP00000250974
MNGLSLSELCCLFCCPPCPGRIAAKLAFLPPEATYSLVPEPEPGPGGAGAAPLGTLRASSGAPGRWKLHLTERADFQYSQRELDTIEVFPTKSARGNRVSCMYVRCVPGARQGHQAQGGHPQLAWVGRLGDSNNPAPGGCLLGKSWGTGAALACGYIHLLARYTVLFSHGNAVDLGQMSSFYIGLGSRLHCNIFSYDYSGYGASSGRPSERNLYADIDAAWQALRTRYGISPDSIILYGQSIGTVPTVDLASRYECAAVVLHSPLTSGMRVAFPDTKKTYCFDAFPNIEKVSKITSPVLIIHGTEDEVIDFSHGLALYERCPKAVEPLWVEGAGHNDIELYSQYLERLRRFISQELPSQRA

SEQ ID NO: 817 - protein, 310 aa, Homo sapiens
  Payload ID: 137;
  Gene Symbol: ABHD17A;
  Gene Name: abhydrolase domain containing 17A;
  Uniprot ID:  Q96GS6;
  ENSP ID: ENSP00000292577
MNGLSLSELCCLFCCPPCPGRIAAKLAFLPPEATYSLVPEPEPGPGGAGAAPLGTLRASSGAPGRWKLHLTERADFQYSQRELDTIEVFPTKSARGNRVSCMYVRCVPGARYTVLFSHGNAVDLGQMSSFYIGLGSRLHCNIFSYDYSGYGASSGRPSERNLYADIDAAWQALRTRYGISPDSIILYGQSIGTVPTVDLASRYECAAVVLHSPLTSGMRVAFPDTKKTYCFDAFPNIEKVSKITSPVLIIHGTEDEVIDFSHGLALYERCPKAVEPLWVEGAGHNDIELYSQYLERLRRFISQELPSQRA

SEQ ID NO: 818 - protein, 39 aa, Homo sapiens
  Payload ID: 137;
  Gene Symbol: ABHD17A;
  Gene Name: abhydrolase domain containing 17A;
  ENSP ID: ENSP00000466977
  MOD_RES (1)..(1): Any amino acid
XYDYSGYGASSGRPSERNLYADIDAAWQALRTRNLGPEL

SEQ ID NO: 819 - protein, 225 aa, Homo sapiens
  Payload ID: 137;
  Gene Symbol: ABHD17A;
  Gene Name: abhydrolase domain containing 17A;
  ENSP ID: ENSP00000467638
MNGLSLSELCCLFCCPPCPGRIAAKLAFLPPEATYSLVPEPEPGPGGAGAAPLGTLRASSGAPGRWKLHLTERADFQYSQRELDTIEVFPTKSARGNRVSCMYVRCVPGASFYIGLGSRLHCNIFSYDYSGYGASSGRPSERNLYADIDAAWQALRTRASARCPPWTWPRATSVPRWCCTRRSPRACASPSPTPRRPTASTPSLTSRRCPRSRLPCSSSTARRTR

SEQ ID NO: 820 - protein, 288 aa, Homo sapiens
  Payload ID: 138;
  Gene Symbol: ABHD17B;
  Gene Name: abhydrolase domain containing 17B;
  Uniprot ID:  Q5VST6;
  ENSP ID: ENSP00000330222
MNNLSFSELCCLFCCPPCPGKIASKLAFLPPDPTYTLMCDESGSRWTLHLSERADWQYSSREKDAIECFMTRTSKGNRIACMFVRCSPNAKYTLLFSHGNAVDLGQMSSFYIGLGSRINCNIFSYDYSGYGASSGKPTEKNLYADIEAAWLALRTRYGIRPENVIIYGQSIGTVPSVDLAARYESAAVILHSPLTSGMRVAFPDTKKTYCFDAFPNIDKISKITSPVLIIHGTEDEVIDFSHGLALFERCQRPVEPLWVEGAGHNDVELYGQYLERLKQFVSQELVNL

SEQ ID NO: 821 - protein, 293 aa, Homo sapiens
  Payload ID: 138;
  Gene Symbol: ABHD17B;
  Gene Name: abhydrolase domain containing 17B;
  Uniprot ID:  Q5VST6;
  ENSP ID: ENSP00000366240
MNNLSFSELCCLFCCPPCPGKIASKLAFLPPDPTYTLMCDESGSRWTLHLSERADWQYSSREKDAIECFMTRTSKGNRIACMFVRCSPNAKYTLLFSHGNAVDLGQMSSFYIGLGSRINCNIFSYDYSGYGASSGKPTEKNLYADIEAAWLALRTRYGIRPENVIIYGQSIGTVPSVDLAARYESAAVILHSPLTSGMRVAFPDTKKTYCFDAFPNIDKISKITSPVLIIHGTEDEVIDFSHGLALFERCQRPVEPLWVEGAGHNDVELYGQYLERLKQFVSQELVQKHKEGK

SEQ ID NO: 822 - protein, 329 aa, Homo sapiens
  Payload ID: 139;
  Gene Symbol: ABHD17C;
  Gene Name: abhydrolase domain containing 17C;
  Uniprot ID:  Q6PCB6;
  ENSP ID: ENSP00000258884
MPEPGPRMNGFSLGELCWLFCCPPCPSRIAAKLAFLPPEPTYTVLAPEQRGAGASAPAPAQATAAAAAAQPAPQQPEEGAGAGPGACSLHLSERADWQYSQRELDAVEVFFSRTARDNRLGCMFVRCAPSSRYTLLFSHGNAVDLGQMCSFYIGLGSRINCNIFSYDYSGYGVSSGKPSEKNLYADIDAAWQALRTRYGVSPENIILYGQSIGTVPTVDLASRYECAAVILHSPLMSGLRVAFPDTRKTYCFDAFPSIDKISKVTSPVLVIHGTEDEVIDFSHGLAMYERCPRAVEPLWVEGAGHNDIELYAQYLERLKQFISHELPNS

SEQ ID NO: 823 - protein, 295 aa, Homo sapiens
  Payload ID: 139;
  Gene Symbol: ABHD17C;
  Gene Name: abhydrolase domain containing 17C;
  Uniprot ID:  Q6PCB6;
  ENSP ID: ENSP00000452778
MPEPGPRMNGFSLGELCWLFCCPPCPSRIAAKLAFLPPEPTYTVLAPEQRGAGASAPAPAQATAAAAAAQPAPQQPEEGAGAGPGACSLHLSERADWQYSQRELDAVEVFFSRTARDNRLGCMFVRCAPSSRYTLLFSHGNAVDLGQMCSFYIGLGSRINCNIFSYDYSGYGVSSGKPSEKNLYADIDAAWQALRTRYGVSPENIILYGQSIGTVPTVDLASSIDKISKVTSPVLVIHGTEDEVIDFSHGLAMYERCPRAVEPLWVEGAGHNDIELYAQYLERLKQFISHELPNS

SEQ ID NO: 824 - protein, 94 aa, Homo sapiens
  Payload ID: 139;
  Gene Symbol: ABHD17C;
  Gene Name: abhydrolase domain containing 17C;
  ENSP ID: ENSP00000453923
MSGLRVAFPDTRKTYCFDAFPSIDKISKVTSPVLVIHGTEDEVIDFSHGLAMYERCPRAVEPLWVEGAGHNDIELYAQYLERLKQFISHELPNS

SEQ ID NO: 825 - protein, 382 aa, Homo sapiens
  Payload ID: 140;
  Gene Symbol: ABHD18;
  Gene Name: abhydrolase domain containing 18;
  ENSP ID: ENSP00000373447
MLDTNLILLPLFQFIVPKEWNSKYRPVCIHLAGTGDHHYWRRRTLMARPMIKEARMASLLLENPYYGCRKPKDQVRSSLKNVSDLFVMGGALVLESAALLHWLEREGYGPLGMTGISMGGHMASLAVSNWPKPMPLIPCLSWSTASGVFTTGVLSKSINWRELEKQYYTQTVYEEEIIHMLEYCGTDSFKMGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSVPVDPSLIIVVQAKEDAYIPRTGVRSLQEIWPGCEIRYLEGGHISAYLFKQGLFRQAIYDAFDRFLHKYAN

SEQ ID NO: 826 - protein, 414 aa, Homo sapiens
  Payload ID: 140;
  Gene Symbol: ABHD18;
  Gene Name: abhydrolase domain containing 18;
  Uniprot ID:  Q0P651;
  ENSP ID: ENSP00000381937
MGVSKLDILYRRLLLTKLFIRGWGRPEDLKRLFEFRKMIGNRERCQNLVSSDYPVHIDKIEEQSDCKILDGHFVSPMAHYVPDIMPIESVIARFQFIVPKEWNSKYRPVCIHLAGTGDHHYWRRRTLMARPMIKEARMASLLLENPYYGCRKPKDQVRSSLKNVSDLFVMGGALVLESAALLHWLEREGYGPLGMTGISMGGHMASLAVSNWPKPMPLIPCLSWSTASGVFTTTDSFKMGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSVPVDPSLIIVVQAKEDAYIPRTGVRSLQEIWPGCEIRYLEGGHISAYLFKQGLFR

SEQ ID NO: 827 - protein, 414 aa, Homo sapiens; identical to SEQ ID NO: 826
  Payload ID: 140;
  Gene Symbol: ABHD18;
  Gene Name: abhydrolase domain containing 18;
  Uniprot ID:  Q0P651;
  ENSP ID: ENSP00000397229

SEQ ID NO: 828 - protein, 105 aa, Homo sapiens
  Payload ID: 140;
  Gene Symbol: ABHD18;
  Gene Name: abhydrolase domain containing 18;
  ENSP ID: ENSP00000421129
MGVSKLDILYRRLLLTKLFIRGWGRPEDLKRLFEFRKMIGNRERCQNLVSSDYPVHIDKIEEQSDCKILDGHFVSPMAHYVPDIMPIESVIARFQFIVPKEWNSK

SEQ ID NO: 829 - protein, 65 aa, Homo sapiens
  Payload ID: 140;
  Gene Symbol: ABHD18;
  Gene Name: abhydrolase domain containing 18;
  ENSP ID: ENSP00000425434
MGVSKLDILYRRLLLTKLFIRGWGRPEDLKRLFEFRKMIGNRERCQNLVSSDYPVHIDKVPIYCA

SEQ ID NO: 830 - protein, 321 aa, Homo sapiens
  Payload ID: 140;
  Gene Symbol: ABHD18;
  Gene Name: abhydrolase domain containing 18;
  Uniprot ID:  Q0P651;
  ENSP ID: ENSP00000480015
MARPMIKEARMASLLLENPYYGCRKPKDQVRSSLKNVSDLFVMGGALVLESAALLHWLEREGYGPLGMTGISMGGHMASLAVSNWPKPMPLIPCLSWSTASGVFTTGVLSKSINWRELEKQYYTQTVYEEEIIHMLEYCGTDSFKMGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSVPVDPSLIIVVQAKEDAYIPRTGVRSLQEIWPGCEIRYLEGGHISAYLFKQGLFR

SEQ ID NO: 831 - protein, 425 aa, Homo sapiens
  Payload ID: 141;
  Gene Symbol: ABHD2;
  Gene Name: abhydrolase domain containing 2;
  Uniprot ID:  P08910;
  ENSP ID: ENSP00000268129
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVICPGIANHSEKQYIRTFVDYAQKNGYRCAVLNHLGALPNIELTSPRMFTYGCTWEFGAMVNYIKKTYPLTQLVVVGFSLGGNIVCKYLGETQANQEKVLCCVSVCQGYSALRAQETFMQWDQCRRFYNFLMADNMKKIILSHRQALFGDHVKKPQSLEDTDLSRLYTATSLMQIDDNVMRKFHGYNSLKEYYEEESCMRYLHRIYVPLMLVNAADDPLVHESLLTIPKSLSEKRENVMFVLPLHGGHLGFFEGSVLFPEPLTWMDKLVVEYANAICQWERNKLQCSDTEQVEADLE

SEQ ID NO: 832 - protein, 425 aa, Homo sapiens; identical to SEQ ID NO: 831
  Payload ID: 141;
  Gene Symbol: ABHD2;
  Gene Name: abhydrolase domain containing 2;
  Uniprot ID:  P08910;
  ENSP ID: ENSP00000347217

SEQ ID NO: 833 - protein, 123 aa, Homo sapiens
  Payload ID: 141;
  Gene Symbol: ABHD2;
  Gene Name: abhydrolase domain containing 2;
  ENSP ID: ENSP00000454531
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVG

SEQ ID NO: 834 - protein, 55 aa, Homo sapiens
  Payload ID: 141;
  Gene Symbol: ABHD2;
  Gene Name: abhydrolase domain containing 2;
  ENSP ID: ENSP00000454645
MNAMLETPELPAVFDGVKLAAVAAVLYVIVRCLNLKSPTAPPDLYFQDSGLSRFL

SEQ ID NO: 835 - protein, 425 aa, Homo sapiens; identical to SEQ ID NO: 831
  Payload ID: 141;
  Gene Symbol: ABHD2;
  Gene Name: abhydrolase domain containing 2;
  Uniprot ID:  P08910;
  ENSP ID: ENSP00000455639

SEQ ID NO: 836 - protein, 131 aa, Homo sapiens
  Payload ID: 141;
  Gene Symbol: ABHD2;
  Gene Name: abhydrolase domain containing 2;
  ENSP ID: ENSP00000457882
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVIC

SEQ ID NO: 837 - protein, 409 aa, Homo sapiens
  Payload ID: 142;
  Gene Symbol: ABHD3;
  Gene Name: abhydrolase domain containing 3;
  Uniprot ID:  Q8WU67;
  ENSP ID: ENSP00000289119
MQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRCVVFNNRGVAGENLLTPRTYCCANTEDLETVIHHVHSLYPSAPFLAAGVSMGGMLLLNYLGKIGSKTPLMAAATFSVGWNTFACSESLEKPLNWLLFNYYLTTCLQSSVNKHRHMFVKQVDMDHVMKAKSIREFDKRFTSVMFGYQTIDDYYTDASPSPRLKSVGIPVLCLNSVDDVFSPSHAIPIETAKQNPNVALVLTSYGGHIGFLEGIWPRQSTYMDRVFKQFVQAMVEHGHELS

SEQ ID NO: 838 - protein, 214 aa, Homo sapiens
  Payload ID: 142;
  Gene Symbol: ABHD3;
  Gene Name: abhydrolase domain containing 3;
  ENSP ID: ENSP00000462578
MTFITPVTEIITYCSLQLQWPSKLFFPRMLLLNYLGKIGSKTPLMAAATFSVGWNTFACSESLEKPLNWLLFNYYLTTCLQSSVNKHRHMFVKQVDMDHVMKAKSIREFDKRFTSVMFGYQTIDDYYTDASPSPRLKSVGIPVLCLNSVDDVFSPSHAIPIETAKQNPNVALVLTSYGGHIGFLEGIWPRQSTYMDRVFKQFVQAMVEHGHELS

SEQ ID NO: 839 - protein, 356 aa, Homo sapiens
  Payload ID: 142;
  Gene Symbol: ABHD3;
  Gene Name: abhydrolase domain containing 3;
  ENSP ID: ENSP00000462935
MQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRMLLLNYLGKIGSKTPLMAAATFSVGWNTFACSESLEKPLNWLLFNYYLTTCLQSSVNKHRHMFVKQVDMDHVMKAKSIREFDKRFTSVMFGYQTIDDYYTDASPSPRLKSVGIPVLCLNSVDDVFSPSHAIPIETAKQNPNVALVLTSYGGHIGFLEGIWPRQSTYMDRVFKQFVQAMVEHGHELS

SEQ ID NO: 840 - protein, 136 aa, Homo sapiens
  Payload ID: 142;
  Gene Symbol: ABHD3;
  Gene Name: abhydrolase domain containing 3;
  Uniprot ID:  Q8WU67;
  ENSP ID: ENSP00000463365
MQRLAMDLRMLSRELSLYLEHQVRVGFFGSGVGLSLILGFSVAYAFYYLSSIAKKRTTRRSGAGRVEDRPCLDLSSLRSPRCSTGMNLLKLQMEDRFHWTGLIMITVRVIWMPAPDLLSYCCLASREQARSHISFI

SEQ ID NO: 841 - protein, 112 aa, Homo sapiens
  Payload ID: 142;
  Gene Symbol: ABHD3;
  Gene Name: abhydrolase domain containing 3;
  ENSP ID: ENSP00000463848
  MOD_RES (1)..(1): Any amino acid
XVVTETYYPTVWCWEGRGQTLLRPFITSKPPVQYRNELIKTADGGQISLDWFDNDNSTCYMDASTRPTILLLPGLTGTSKESYILHMIHLSEELGYRCVVFNNRGVAGENLL

SEQ ID NO: 842 - protein, 37 aa, Homo sapiens
  Payload ID: 142;
  Gene Symbol: ABHD3;
  Gene Name: abhydrolase domain containing 3;
  ENSP ID: ENSP00000463996
  MOD_RES (1)..(1): Any amino acid
XYTDASPSPRLKSVGIPVLCLNSVDDVFSPSHGNLRS

SEQ ID NO: 843 - protein, 149 aa, Homo sapiens
  Payload ID: 143;
  Gene Symbol: ABHD4;
  Gene Name: abhydrolase domain containing 4;
  ENSP ID: ENSP00000216327
MADDLEQQSQGWLSSWLPTWRPTSMSQLKNVEARILQCFGRSSRPAFPRDPEGAEDEFVTSIETWRETMGIPSMILLGHSLGGFLATSYSIKYPDRVKHLILVDPWGFPLRPTNPSEIRAPPAWVKAVASVLGRSNPLAVLRVAGPWGE

SEQ ID NO: 844 - protein, 181 aa, Homo sapiens
  Payload ID: 143;
  Gene Symbol: ABHD4;
  Gene Name: abhydrolase domain containing 4;
  Uniprot ID:  Q8TB40;
  ENSP ID: ENSP00000388751
MADDLEQQSQGWLSSWLPTWRPTSMSQLKNVEARILQCLQNKFLARYVSLPNQNKIWTVTVSPEQNDRTPLVMVHGFGGGVGLWILNMDSLSARRTLHTFDLLGFGRSSRPAFPRDPEGAEDEFVTSIETWRETMGIPSMILLGHSLGGFLATSYSIKYPDRAWSGAAIPAGLQTQVCRLL

SEQ ID NO: 845 - protein, 342 aa, Homo sapiens
  Payload ID: 143;
  Gene Symbol: ABHD4;
  Gene Name: abhydrolase domain containing 4;
  Uniprot ID:  Q8TB40;
  ENSP ID: ENSP00000414558
MADDLEQQSQGWLSSWLPTWRPTSMSQLKNVEARILQCLQNKFLARYVSLPNQNKIWTVTVSPEQNDRTPLVMVHGFGGGVGLWILNMDSLSARRTLHTFDLLGFGRSSRPAFPRDPEGAEDEFVTSIETWRETMGIPSMILLGHSLGGFLATSYSIKYPDRVKHLILVDPWGFPLRPTNPSEIRAPPAWVKAVASVLGRSNPLAVLRVAGPWGPGLVQRFRPDFKRKFADFFEDDTISEYIYHCNAQNPSGETAFKAMMESFGWARRPMLERIHLIRKDVPITMIYGSDTWIDTSTGKKVKMQRPDSYVRDMEIKGASHHVYADQPHIFNAVVEEICDSVD

SEQ ID NO: 846 - protein, 90 aa, Homo sapiens
  Payload ID: 143;
  Gene Symbol: ABHD4;
  Gene Name: abhydrolase domain containing 4;
  ENSP ID: ENSP00000437385
MSQLKNVEARILQCLQNKFLARYVSLPNQNKIWTVTVSPEQNDRTPLVMVHGFGGGVGLWILNMDSLSARRTLHTFDLLGFGRSSRPAFP

SEQ ID NO: 847 - protein, 54 aa, Homo sapiens
  Payload ID: 143;
  Gene Symbol: ABHD4;
  Gene Name: abhydrolase domain containing 4;
  ENSP ID: ENSP00000438014
  MOD_RES (1)..(1): Any amino acid
XSQGWLSSWLPTWRPTSMSQLKNVEARILQCLQNKFLARYVSLPNQNKIWTVTS

SEQ ID NO: 848 - protein, 85 aa, Homo sapiens
  Payload ID: 143;
  Gene Symbol: ABHD4;
  Gene Name: abhydrolase domain containing 4;
  ENSP ID: ENSP00000438332
MADDLEQQSQGWLSSWLPTWRPTSMSQLKNVEARILQCLQNKFLARYVSLPNQNKIWTVTVSPEQNDRTPLVMLKASIPKGPGGG

SEQ ID NO: 849 - protein, 44 aa, Homo sapiens
  Payload ID: 143;
  Gene Symbol: ABHD4;
  Gene Name: abhydrolase domain containing 4;
  ENSP ID: ENSP00000444550
MCPQSHCWSQGWLSSWLPTWRPTSMSQLKNVEARILQCLQNKFL

SEQ ID NO: 850 - protein, 44 aa, Homo sapiens
  Payload ID: 144;
  Gene Symbol: ABHD5;
  Gene Name: abhydrolase domain containing 5;
  ENSP ID: ENSP00000013894
MAAEEEEVDSADTGERSGWLTGWLPTWCPTSISHLKEAEEKMLK

SEQ ID NO: 851 - protein, 349 aa, Homo sapiens
  Payload ID: 144;
  Gene Symbol: ABHD5;
  Gene Name: abhydrolase domain containing 5;
  Uniprot ID:  Q8WTS1;
  ENSP ID: ENSP00000390849
MAAEEEEVDSADTGERSGWLTGWLPTWCPTSISHLKEAEEKMLKCVPCTYKKEPVRISNGNKIWTLKFSHNISNKTPLVLLHGFGGGLGLWALNFGDLCTNRPVYAFDLLGFGRSSRPRFDSDAEEVENQFVESIEEWRCALGLDKMILLGHNLGGFLAAAYSLKYPSRVNHLILVEPWGFPERPDLADQDRPIPVWIRALGAALTPFNPLAGLRIAGPFGLSLVQRLRPDFKRKYSSMFEDDTVTEYIYHCNVQTPSGETAFKNMTIPYGWAKRPMLQRIGKMHPDIPVSVIFGARSCIDGNSGTSIQSLRPHSYVKTIAILGAGHYVYADQPEEFNQKVKEICDTVD

SEQ ID NO: 852 - protein, 126 aa, Homo sapiens
  Payload ID: 144;
  Gene Symbol: ABHD5;
  Gene Name: abhydrolase domain containing 5;
  ENSP ID: ENSP00000391582
MLKCVPCTYKKEPVRISNGNKIWTLKFSHNISNKTPLVLLHGFGGGLGLWALNFGDLCTNRPVYAFDLLGFGRSSRPRFDSDAEEVENQFVESIEEWRCALGLDKMILLGHNLGGFLAAAYSLKYP

SEQ ID NO: 853 - protein, 155 aa, Homo sapiens
  Payload ID: 144;
  Gene Symbol: ABHD5;
  Gene Name: abhydrolase domain containing 5;
  ENSP ID: ENSP00000392159
RVNHLILVEPWGFPERPDLADQDRPIPVWIRALGAALTPFNPLAGLRIAGPFGLSLVQRLRPDFKRKYSSMFEDDTVTEYIYHCNVQTPSFSDLWRPILHRWQFWHQHPVLTTTFICEDNSYSWGRTLCICRSTRRIQPESKGDLRHCGLNTLKL

SEQ ID NO: 854 - protein, 45 aa, Homo sapiens
  Payload ID: 144;
  Gene Symbol: ABHD5;
  Gene Name: abhydrolase domain containing 5;
  ENSP ID: ENSP00000412014
MLKCVPCTYKKEPVRISNGNKIWTLKFSHNISNKTPLVLLHGFGG

SEQ ID NO: 855 - protein, 337 aa, Homo sapiens
  Payload ID: 145;
  Gene Symbol: ABHD6;
  Gene Name: abhydrolase domain containing 6;
  Uniprot ID:  Q9BV23;
  ENSP ID: ENSP00000295962
MDLDVVNMFVIAGGTLAIPILAFVASFLLWPSALIRIYYWYWRRTLGMQVRYVHHEDYQFCYSFRGRPGHKPSILMLHGFSAHKDMWLSVVKFLPKNLHLVCVDMPGHEGTTRSSLDDLSIDGQVKRIHQFVECLKLNKKPFHLVGTSMGGQVAGVYAAYYPSDVSSLCLVCPAGLQYSTDNQFVQRLKELQGSAAVEKIPLIPSTPEEMSEMLQLCSYVRFKVPQQILQGLVDVRIPHNNFYRKLFLEIVSEKSRYSLHQNMDKIKVPTQIIWGKQDQVLDVSGADMLAKSIANCQVELLENCGHSVVMERPRKTAKLIIDFLASVHNTDNNKKLD

SEQ ID NO: 856 - protein, 51 aa, Homo sapiens
  Payload ID: 145;
  Gene Symbol: ABHD6;
  Gene Name: abhydrolase domain containing 6;
  ENSP ID: ENSP00000418209
MDLDVVNMFVIAGGTLAIPILAFVASFLLWPSALIRIYYCMSSVKDVAALS

SEQ ID NO: 857 - protein, 173 aa, Homo sapiens
  Payload ID: 145;
  Gene Symbol: ABHD6;
  Gene Name: abhydrolase domain containing 6;
  ENSP ID: ENSP00000418934
MDLDVVNMFVIAGGTLAIPILAFVASFLLWPSALIRIYYWYWRRTLGMQVRYVHHEDYQFCYSFRGRPGHKPSILMLHGFSAHKDMWLSVVKFLPKNLHLVCVDMPGHEGTTRSSLDDLSIDGQVKRIHQFVECLKLNKKPFHLVGTSMGGQVAGVYAAYYPSDVSSLCLVCP

SEQ ID NO: 858 - protein, 337 aa, Homo sapiens; identical to SEQ ID NO: 855
  Payload ID: 145;
  Gene Symbol: ABHD6;
  Gene Name: abhydrolase domain containing 6;
  Uniprot ID:  Q9BV23;
  ENSP ID: ENSP00000420315

SEQ ID NO: 859 - protein, 225 aa, Homo sapiens
  Payload ID: 145;
  Gene Symbol: ABHD6;
  Gene Name: abhydrolase domain containing 6;
  ENSP ID: ENSP00000420408
MDLDVVNMFVIAGGTLAIPILAFVASFLLWPSALIRIYYWYWRRTLGMQVRYVHHEDYQFCYSFRGRPGHKPSILMLHGFSAHKDMWLSVVKFLPKNLHLVCVDMPGHEGTTRSSLDDLSIDGQVKRIHQFVECLKLNKKPFHLVGTSMGGQVAGVYAAYYPSDVSSLCLVCPAGLQYSTDNQFVQRLKELQGSAAVEKIPLIPSTPEEMSEMLQLCSYVRFKVP

SEQ ID NO: 860 - protein, 318 aa, Homo sapiens
  Payload ID: 145;
  Gene Symbol: ABHD6;
  Gene Name: abhydrolase domain containing 6;
  ENSP ID: ENSP00000484876
MDLDVVNMFVIAGGTLAIPILAFVASFLLWPSALIRIYYWYWRRTLGMQVRYVHHEDYQFCYSFRGRPGHKPSILMLHGFSAHKDMWLSVVKFLPKNLHLVCVDMPGHEGTTRSSLDDLSIDGQVKRIHQFVECLKLNKKPFHLVGTSMGGQVAGVYAAYYPSDVSSLCLVCPAGLQYSTDNQFVQRLKELQGSAAVEKIPLIPSTPEEMSEMLQLCSYVRFKVPQQILQGLVDVRIPHNNFYRKLFLEIVSEKSRYSLHQNMDKIKVPTQIIWGKQDQVLDVSGADVGQVNCQLPGGASGKLWALSSDGKPGRQPSS

SEQ ID NO: 861 - protein, 439 aa, Homo sapiens
  Payload ID: 146;
  Gene Symbol: ABHD8;
  Gene Name: abhydrolase domain containing 8;
  Uniprot ID:  Q96I13;
  ENSP ID: ENSP00000247706
MLTGVTDGIFCCLLGTPPNAVGPLESVESSDGYTFVEVKPGRVLRVKHAGPAPAAAPPPPSSASSDAAQGDLSGLVRCQRRITVYRNGRLLVENLGRAPRADLLHGQNGSGEPPAALEVELADPAGSDGRLAPGSAGSGSGSGSGGRRRRARRPKRTIHIDCEKRITSCKGAQADVVLFFIHGVGGSLAIWKEQLDFFVRLGYEVVAPDLAGHGASSAPQVAAAYTFYALAEDMRAIFKRYAKKRNVLIGHSYGVSFCTFLAHEYPDLVHKVIMINGGGPTALEPSFCSIFNMPTCVLHCLSPCLAWSFLKAGFARQGAKEKQLLKEGNAFNVSSFVLRAMMSGQYWPEGDEVYHAELTVPVLLVHGMHDKFVPVEEDQRMAEILLLAFLKLIDEGSHMVMLECPETVNTLLHEFLLWEPEPSPKALPEPLPAPPEDKK

SEQ ID NO: 862 - protein, 175 aa, Homo sapiens
  Payload ID: 146;
  Gene Symbol: ABHD8;
  Gene Name: abhydrolase domain containing 8;
  ENSP ID: ENSP00000468883
MRIGDKSFSFLEAGHTMLTGVTDGIFCCLLGTPPNAVGPLESVESSDGYTFVEVKPGRVLRVKHAGPAPAAAPPPPSSASSDAAQGDLSGLVRCQRRITVYRNGRLLVENLGRAPRADLLHGQNGSGEPPAALEVELADPAGSDGRLAPGSAGSGSGSGSGGRRRRARRPKRTIH

SEQ ID NO: 863 - protein, 130 aa, Homo sapiens
  Payload ID: 146;
  Gene Symbol: ABHD8;
  Gene Name: abhydrolase domain containing 8;
  ENSP ID: ENSP00000470413
MRNIPTQDATTFPVDTLWGHTMLTGVTDGIFCCLLGTPPNAVGPLESVESSDGYTFVEVKPGRVLRVKHAGPAPAAAPPPPSSASSDAAQGDLSGLVRCQRRITVYRNGRLLVENLGRAPRADLLHGQNG

SEQ ID NO: 864 - protein, 366 aa, Homo sapiens
  Payload ID: 147;
  Gene Symbol: ABI3;
  Gene Name: ABI family, member 3;
  Uniprot ID:  Q9P2A4;
  ENSP ID: ENSP00000225941
MAELQQLQEFEIPTGREALRGNHSALLRVADYCEDNYVQATDKRKALEETMAFTTQALASVAYQVGNLAGHTLRMLDLQGAALRQVEARVSTLGQMVNMHMEKVARREIGTLATVQRLPPGQKVIAPENLPPLTPYCRRPLNFGCLDDIGHGIKDLSTQLSRTGTLSRKSIKAPATPASATLGRPPRIPEPVHLPVVPDGRLSAASSAFSLASAGSAEGVGGAPTPKGQAAPPAPPLPSSLDPPPPPAAVEVFQRPPTLEELSPPPPDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 865 - protein, 360 aa, Homo sapiens
  Payload ID: 147;
  Gene Symbol: ABI3;
  Gene Name: ABI family, member 3;
  Uniprot ID:  Q9P2A4;
  ENSP ID: ENSP00000406651
MAELQQLQEFEIPTGREALRGNHSALLRVADYCEDNYVQATDKRKALEETMAFTTQALASVAYQVGNLAGHTLRMLDLQGAALRQVEARMVNMHMEKVARREIGTLATVQRLPPGQKVIAPENLPPLTPYCRRPLNFGCLDDIGHGIKDLSTQLSRTGTLSRKSIKAPATPASATLGRPPRIPEPVHLPVVPDGRLSAASSAFSLASAGSAEGVGGAPTPKGQAAPPAPPLPSSLDPPPPPAAVEVFQRPPTLEELSPPPPDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 866 - protein, 191 aa, Homo sapiens
  Payload ID: 147;
  Gene Symbol: ABI3;
  Gene Name: ABI family, member 3;
  ENSP ID: ENSP00000459171
  MOD_RES (1)..(1): Any amino acid
XRPPRIPEPVHLPVVPDGRLSAASSAFSLASAGSAEGVGGAPTPKGQAAPPAPPLPSSLDPPPPPAAVEVFQRPPTLEELSPPPPAFLLFPQDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 867 - protein, 160 aa, Homo sapiens
  Payload ID: 147;
  Gene Symbol: ABI3;
  Gene Name: ABI family, member 3;
  ENSP ID: ENSP00000460776
  MOD_RES (1)..(1): Any amino acid
XTGTLSRKSIKAPATPASATLGRPPRIPEPVHLPVVPDGRLSAASSAFSLASAGSAEGVGGAPTPKGQAAPPAPPLPSSLDPPPPPAAVEVFQRPPTLEELSPPPPAFLLFPQDEELPLPLDLPPPPPLDGDELGLPPPPPGFGPDEPSWVPASYLEKGT

SEQ ID NO: 868 - protein, 1075 aa, Homo sapiens
  Payload ID: 148;
  Gene Symbol: ABI3BP;
  Gene Name: ABI family, member 3 (NESH) binding prt;
  Uniprot ID:  Q7Z7G0;
  ENSP ID: ENSP00000284322
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 869 - protein, 84 aa, Homo sapiens
  Payload ID: 148;
  Gene Symbol: ABI3BP;
  Gene Name: ABI family, member 3 (NESH) binding prt;
  ENSP ID: ENSP00000417325
  MOD_RES (1)..(1): Any amino acid
XFEKPRGTLASSEKPWIVPTAKISEDSKVLQPQTATSDRILDSIPPKTSRTLEQPRATLAPSETPFVPQKLEIFTSPEMQPTTP

SEQ ID NO: 870 - protein, 187 aa, Homo sapiens
  Payload ID: 148;
  Gene Symbol: ABI3BP;
  Gene Name: ABI family, member 3 (NESH) binding prt;
  ENSP ID: ENSP00000417745
  MOD_RES (1)..(1): Any amino acid
XKTTPHPEVPQTKLAPKVPQRTHRPHPKPKTTLSPEELQTELVPATIFEPVSPIKEAPGTTFVPVTDLEPVTFRTEIPATTLATKTSKRTRPPRPRPKTTPSPQAPETKPAPKQTPRAPPKPKTSPRPRIPQTQPVPKVPQRVTAKPKTSPSPEVSYTTPAPLETRGIPFIPMISPSPSQEELQTTL

SEQ ID NO: 871 - protein, 307 aa, Homo sapiens
  Payload ID: 148;
  Gene Symbol: ABI3BP;
  Gene Name: ABI family, member 3 (NESH) binding prt;
  ENSP ID: ENSP00000418024
  MOD_RES (1)..(1): Any amino acid
XPKPKTTPHPEVPQTKLATKTSKRTRPPRPRPKTTPSPQAPETKPVPATVLEPVTLRPEASTTLASKTSQRTRRPRLRTKTTPRPEAPESKPVPTAELKPVTLRTETWVTTQAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKP

SEQ ID NO: 872 - protein, 187 aa, Homo sapiens
  Payload ID: 148;
  Gene Symbol: ABI3BP;
  Gene Name: ABI family, member 3 (NESH) binding prt;
  ENSP ID: ENSP00000418063
  MOD_RES (1)..(1): Any amino acid
XFISLKPKIPLSPEVTHTKPAPKTSQRTRTRRPRPKHKTTPRPETLQTKLDFGPITPGTSSAPTTTTKRTRRPHPKPKTTPHPEVPQTKLAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTL

SEQ ID NO: 873 - protein, 187 aa, Homo sapiens
  Payload ID: 148;
  Gene Symbol: ABI3BP;
  Gene Name: ABI family, member 3 (NESH) binding prt;
  ENSP ID: ENSP00000418479
  MOD_RES (1)..(1): Any amino acid
XNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLASSEKPWIVPTAKISEDSKVLQPQT

SEQ ID NO: 874 - protein, 158 aa, Homo sapiens
  Payload ID: 148;
  Gene Symbol: ABI3BP;
  Gene Name: ABI family, member 3 (NESH) binding prt;
  ENSP ID: ENSP00000418800
VSDVLESVTLSTESPKETIAPAKTDYVYPTAKAPLWPEEPKTEVVESITYVSEPPETTLETSPLPSQSITLPSPDEPQTEPAPKQTPRAPPKPKTSPRPRIPQTQPVPKVPQRVTAKPKTSPSPEVSYTTPAPLETRGIPFIPMISPSPSQEELQTTL

SEQ ID NO: 875 - protein, 1131 aa, Homo sapiens
  Payload ID: 148;
  Gene Symbol: ABI3BP;
  Gene Name: ABI family, member 3 (NESH) binding prt;
  ENSP ID: ENSP00000418817
  MOD_RES (1)..(1): Any amino acid
XISLKPKIPLSPEVTHTKPAPEPQTLLPSQSTIGPETPGTKPSTTLALEPATIQPEPLVPTTASKPSERPKTTHRPDAPQIQPGSKPPKQLLPKPQTTAEPDMPPTKSVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLVPATILEPVLRTEASGTTAVPATIFEPVSPIKEAPGTTFVPVTDLEPVTFRTEIPATTLATKTSKRTRPPRPRPKTTPSPQAPETKPVPATVLEPVTLRPEASTTLASKTSQRTRRPRLRTKTTPRPEAPESKPVPTAELKPVTLRTETWVTTQAPKTSQRTRRPRPKTKTTPSPEVPQTKLVPSTDLEPGTLRTEAPKTMVVTTVLEPDTFRTKFPETTLAPKTQRTRRPRPRPKTTSSPEVPQNKSVSVTGFEPVVHSTDAPGTTFALTELQTLILKPVTSPSLEMTESQPVSDVLESVTLSTESPKETIAPAKTDYVYPTAKAPLWPEEPKTEVVESITYVSEPPETTLETSPLPSQSITLPSPDEPQTEPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 876 - protein, 233 aa, Homo sapiens
  Payload ID: 148;
  Gene Symbol: ABI3BP;
  Gene Name: ABI family, member 3 (NESH) binding prt;
  ENSP ID: ENSP00000419029
QRVTAKPKTSPSPEVSYTTPAPKDVLLPHKPYPEVSQSEPAPLETRGIPFIPMISPSPSQEELQTTLAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVK

SEQ ID NO: 877 - protein, 1777 aa, Homo sapiens
  Payload ID: 148;
  Gene Symbol: ABI3BP;
  Gene Name: ABI family, member 3 (NESH) binding prt;
  ENSP ID: ENSP00000420524
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLAPKSLPEFPEAKTPFPFEKPRGTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPEPQTLLPSQSTIGPETPGTKPSTTLAPRKTKRPGRRPRPRPRPKTTPSPEVPKSKPALEPATIQPEPLVPTTASKPSERPKTTHRPDAPQIQPGSKPPKQLLPKPQTTAEPDMPPTKSVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLVPATILEPVLRTEASGTTAAPKVPQRTHRPHPKPKTTLSPEELQTELVPATIFEPVSPIKEAPGTTFVPVTDLEPVTFRTEIPATTLATKTSKRTRPPRPRPKTTPSPQAPETKPVPATVLEPVTLRPEASTTLASKTSQRTRRPRLRTKTTPRPEAPESKPVPTAELKPVTLRTETWVTTQAPKTSQRTRRPRPKTKTTPSPEVPQTKLVPSTDLEPGTLRTEAPKTMVVTTVLEPDTFRTKFPETTLAPKTQRTRRPRPRPKTTSSPEVPQNKSVSVTGFEPVVHSTDAPGTTFALTELQTLILKPVTSPSLEMTESQPVSDVLESVTLSTESPKETIAPAKTDYVYPTAKAPLWPEEPKTEVVESITYVSEPPETTLETSPLPSQSITLPSPDEPQTEPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 878 - protein, 189 aa, Homo sapiens
  Payload ID: 148;
  Gene Symbol: ABI3BP;
  Gene Name: ABI family, member 3 (NESH) binding prt;
  ENSP ID: ENSP00000420704
  MOD_RES (1)..(1): Any amino acid
XTAKPKTSPSPEVSYTTPAPLETRGIPFIPMISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKPGTRRPPLPPRPTHPRRKPLPPNNVTGKPGSAGIISSGPITTPPLRS

SEQ ID NO: 879 - protein, 151 aa, Homo sapiens
  Payload ID: 148;
  Gene Symbol: ABI3BP;
  Gene Name: ABI family, member 3 (NESH) binding prt;
  ENSP ID: ENSP00000431537
  MOD_RES (1)..(1): Any amino acid
XVESITYVSEPPETTLETSPLPSQSITLPSPDEPQTEPAPKQTPRAPPKPKTSPRPRIPQTQPVPKVPQRVTAKPKTSPSPEVSYTTPAPKDVLLPHKPYPEVSQSEPVLQPVTFRFEPPKTTIAPLETRGIPFIPMISPSPSQEELQTTL

SEQ ID NO: 880 - protein, 125 aa, Homo sapiens
  Payload ID: 148;
  Gene Symbol: ABI3BP;
  Gene Name: ABI family, member 3 (NESH) binding prt;
  ENSP ID: ENSP00000432069
  MOD_RES (1)..(1): Any amino acid
XKNETLALPAESKTPEVEKISARPTTVTPETVPRSTKPTTSSALDVSETTLAPKSLPEFPEAKTPFPFEKPRGTLASSEKPWIVPTAKISEDSKVLQPQTALTELQTLILKPVTSPSLEMTESQP

SEQ ID NO: 881 - protein, 187 aa, Homo sapiens
  Payload ID: 148;
  Gene Symbol: ABI3BP;
  Gene Name: ABI family, member 3 (NESH) binding prt;
  ENSP ID: ENSP00000433981
PRKTKRPGRRPRPRPRPKTTPSPEVPKSKPALEPATIQPEPLVPTTASKPSERPKTTHRPDAPQIQPVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLAPKQTPRAPPKPKT

SEQ ID NO: 882 - protein, 1005 aa, Homo sapiens
  Payload ID: 148;
  Gene Symbol: ABI3BP;
  Gene Name: ABI family, member 3 (NESH) binding prt;
  ENSP ID: ENSP00000433993
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLAPKSLPEFPEAKTPFPFEKPRGTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPEPQTLLPSQSTIGPETPGTKPSTTLAPRKTKRPGRRPRPRPRPKTTPSPEVPKSKPALEPATIQPEPLVPTTASKPSERPKTTHRPDAPQIQPGSKPPKQLLPKPQTTAEPDMPPTKSVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLATKTSKRTRPPRPRPKTTPSPQAPETKPVPATVLEPVTLRPEASTTLASKTSQRTRRPRLRTKTTPRPEAPESKPVPTAELKPVTLRTETWVTTQAPKTSQRTRRPRPKTKTTPSPEVPQTKLVPSTDLEPGTLRTEAPKTMVVTTVLEPDTFRTKFPETTLAPKTQRTRRPRPRPKTTSSPEVPQNKSGKCMNPWLK

SEQ ID NO: 883 - protein, 60 aa, Homo sapiens
  Payload ID: 148;
  Gene Symbol: ABI3BP;
  Gene Name: ABI family, member 3 (NESH) binding prt;
  ENSP ID: ENSP00000434256
MRGGKCNMLSSLGCLLLCGSITLALGNAQKLPKANKRTELVIQHGWMSLIKMMLNERSQV

SEQ ID NO: 884 - protein, 87 aa, Homo sapiens
  Payload ID: 148;
  Gene Symbol: ABI3BP;
  Gene Name: ABI family, member 3 (NESH) binding prt;
  ENSP ID: ENSP00000434425
  MOD_RES (1)..(1): Any amino acid
XQTLLPSQSTIGPETPGTKPSTTLAPRKTKRPGRRPRPRPRPKTTPSPEVPKSKPALEPATIQPEPLVPTTVSEPVPFETEAPSMTI

SEQ ID NO: 885 - protein, 191 aa, Homo sapiens
  Payload ID: 148;
  Gene Symbol: ABI3BP;
  Gene Name: ABI family, member 3 (NESH) binding prt;
  ENSP ID: ENSP00000435319
CIVVLWYGWLHFYAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKA

SEQ ID NO: 886 - protein, 187 aa, Homo sapiens
  Payload ID: 148;
  Gene Symbol: ABI3BP;
  Gene Name: ABI family, member 3 (NESH) binding prt;
  ENSP ID: ENSP00000436070
  MOD_RES (1)..(1): Any amino acid
XRTTSAGTITPKISKSPEPTWTTPAPGKTQFISLKPKIPLSPEVTHTKPVPTTDIEPVTVRTEATVTTLAPKTSQRTRTRRPRPKHKTTPRPETLQTKLDFGPITPGTSSAPTTTTKRTRRPHPKPKTTPHPEVPQTKLAPKVPQRTHRPHPKPKTTLSPEELQTELVPATIFEPVSPIKEAPGTTF

SEQ ID NO: 887 - protein, 161 aa, Homo sapiens
  Payload ID: 148;
  Gene Symbol: ABI3BP;
  Gene Name: ABI family, member 3 (NESH) binding prt;
  ENSP ID: ENSP00000436918
MRGGKCNMLSSLGCLLLCGSITLALGNAQKLPKDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVG

SEQ ID NO: 888 - protein, 303 aa, Homo sapiens
  Payload ID: 148;
  Gene Symbol: ABI3BP;
  Gene Name: ABI family, member 3 (NESH) binding prt;
  ENSP ID: ENSP00000437031
  MOD_RES (1)..(1): Any amino acid
XTPEVEKISARPTTVTPETVPRSTKPTTSSALDVSETTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPEPQTLLPSQSTIGPETPGTKPSTTLAPRKTKRPGRRPRPRPRPKTTPSPEVPKSKPALEPATIQPEPLVPTTASKPSERPKTTHRPDAPQI

SEQ ID NO: 889 - protein, 150 aa, Homo sapiens
  Payload ID: 148;
  Gene Symbol: ABI3BP;
  Gene Name: ABI family, member 3 (NESH) binding prt;
  ENSP ID: ENSP00000437308
  MOD_RES (1)..(1): Any amino acid
XPETPGTKPSTTLAPRKTKRPGRRPRPRPRPKTTPSPEVPKSKPALEPATIQPEPLVPTTVPTTDIEPVTVRTEATVTTLAPKTSQRTRTRRPRPKHKTTPRPETLQTKLDFGPITPGTSSAPTTTTKRTRRPHPKPKTTPHPEVPQTKL

SEQ ID NO: 890 - protein, 1130 aa, Homo sapiens
  Payload ID: 149;
  Gene Symbol: ABL1;
  Gene Name: ABL proto-oncogene 1, non-receptor tyr kinase;
  Uniprot ID:  P00519;
  ENSP ID: ENSP00000323315
MLEICLKLVGCKSKKGLSSSSSCYLEEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 891 - protein, 1149 aa, Homo sapiens
  Payload ID: 149;
  Gene Symbol: ABL1;
  Gene Name: ABL proto-oncogene 1, non-receptor tyr kinase;
  Uniprot ID:  P00519;
  ENSP ID: ENSP00000361423
MGQQPGKVLGDQRRPSLPALHFIKGAGKKESSRHGGPHCNVFVEHEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 892 - protein, 64 aa, Homo sapiens
  Payload ID: 149;
  Gene Symbol: ABL1;
  Gene Name: ABL proto-oncogene 1, non-receptor tyr kinase;
  ENSP ID: ENSP00000376971
MGQQPGKVLGDQRRPSLPALHFIKGAGKKESSRHGGPHCNVFVEHALQRPVASDFEPQGLSEAA

SEQ ID NO: 893 - protein, 1064 aa, Homo sapiens
  Payload ID: 150;
  Gene Symbol: ABL2;
  Gene Name: ABL proto-oncogene 2, non-receptor tyr kinase;
  Uniprot ID:  P42684;
  ENSP ID: ENSP00000339209
MVLGTVLLPPNSYGRDQDTSLCCLCTEASESALPDLTDHFASCVEDGFEGDKTGGSSPEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 894 - protein, 1161 aa, Homo sapiens
  Payload ID: 150;
  Gene Symbol: ABL2;
  Gene Name: ABL proto-oncogene 2, non-receptor tyr kinase;
  Uniprot ID:  P42684;
  ENSP ID: ENSP00000356595
MGQQVGRVGEAPGLQQPQPRGIRGSSAARPSGRRRDPAGRTTETGFNIFTQHEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGNFSSVASLQHADGFSFTPAQQEANLVPPKCYGGSFAQRNLCNDDGGGGGGSGTAGGGWSGITGFFTPRLIKKTLGLRAGKPTASDDTSKPFPRSNSTSSMSSGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 895 - protein, 542 aa, Homo sapiens
  Payload ID: 150;
  Gene Symbol: ABL2;
  Gene Name: ABL proto-oncogene 2, non-receptor tyr kinase;
  Uniprot ID:  P42684;
  ENSP ID: ENSP00000375897
MGQQVGRVGEAPGLQQPQPRGIRGSSAARPSGRRRDPAGRTTETGFNIFTQHEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEVLLHCANQTCITL

SEQ ID NO: 896 - protein, 1058 aa, Homo sapiens
  Payload ID: 150;
  Gene Symbol: ABL2;
  Gene Name: ABL proto-oncogene 2, non-receptor tyr kinase;
  Uniprot ID:  P42684;
  ENSP ID: ENSP00000423413
MGQQVGRVGEAPGLQQPQPRGIRGSSAARPSGRRRDPAGRTTETGFNIFTQHEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 897 - protein, 1167 aa, Homo sapiens
  Payload ID: 150;
  Gene Symbol: ABL2;
  Gene Name: ABL proto-oncogene 2, non-receptor tyr kinase;
  Uniprot ID:  P42684;
  ENSP ID: ENSP00000423578
MVLGTVLLPPNSYGRDQDTSLCCLCTEASESALPDLTDHFASCVEDGFEGDKTGGSSPEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGNFSSVASLQHADGFSFTPAQQEANLVPPKCYGGSFAQRNLCNDDGGGGGGSGTAGGGWSGITGFFTPRLIKKTLGLRAGKPTASDDTSKPFPRSNSTSSMSSGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 898 - protein, 1079 aa, Homo sapiens
  Payload ID: 150;
  Gene Symbol: ABL2;
  Gene Name: ABL proto-oncogene 2, non-receptor tyr kinase;
  Uniprot ID:  P42684;
  ENSP ID: ENSP00000424697
MGQQVGRVGEAPGLQQPQPRGIRGSSAARPSGRRRDPAGRTTETGFNIFTQHDHFASCVEDGFEGDKTGGSSPEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 899 - protein, 1043 aa, Homo sapiens
  Payload ID: 150;
  Gene Symbol: ABL2;
  Gene Name: ABL proto-oncogene 2, non-receptor tyr kinase;
  Uniprot ID:  P42684;
  ENSP ID: ENSP00000426831
MVLGTVLLPPNSYGRDQDTSLCCLCTEASESALPDLTEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 900 - protein, 1182 aa, Homo sapiens
  Payload ID: 150;
  Gene Symbol: ABL2;
  Gene Name: ABL proto-oncogene 2, non-receptor tyr kinase;
  Uniprot ID:  P42684;
  ENSP ID: ENSP00000427562
MGQQVGRVGEAPGLQQPQPRGIRGSSAARPSGRRRDPAGRTTETGFNIFTQHDHFASCVEDGFEGDKTGGSSPEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGNFSSVASLQHADGFSFTPAQQEANLVPPKCYGGSFAQRNLCNDDGGGGGGSGTAGGGWSGITGFFTPRLIKKTLGLRAGKPTASDDTSKPFPRSNSTSSMSSGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 901 - protein, 496 aa, Homo sapiens
  Payload ID: 151;
  Gene Symbol: ABI1;
  Gene Name: abl-interactor 1;
  Uniprot ID:  Q8IZP0;
  ENSP ID: ENSP00000279599
MAELQMLLEEEIPSGKRALIESYQNLTRVADYCENNYIQRHGFAVLLCLLSNSWPQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPENISVPPPSGAPPAPPLAPLLPVSTVIAAPGSAPGSQYGTMTRQISRHNSTTSSTSSGGYRRTPSVTAQFSAQPHVNGGPLYSQNSIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 902 - protein, 480 aa, Homo sapiens
  Payload ID: 151;
  Gene Symbol: ABI1;
  Gene Name: abl-interactor 1;
  Uniprot ID:  Q8IZP0;
  ENSP ID: ENSP00000352114
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 903 - protein, 422 aa, Homo sapiens
  Payload ID: 151;
  Gene Symbol: ABI1;
  Gene Name: abl-interactor 1;
  Uniprot ID:  Q8IZP0;
  ENSP ID: ENSP00000365307
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPVSIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 904 - protein, 452 aa, Homo sapiens
  Payload ID: 151;
  Gene Symbol: ABI1;
  Gene Name: abl-interactor 1;
  Uniprot ID:  Q8IZP0;
  ENSP ID: ENSP00000365308
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAAPGSAPGSQYGTMTRQISRHNSTTSSTSSGGYRRTPSVTAQFSAQPHVNGGPLYSQNSIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 905 - protein, 476 aa, Homo sapiens
  Payload ID: 151;
  Gene Symbol: ABI1;
  Gene Name: abl-interactor 1;
  Uniprot ID:  Q8IZP0;
  ENSP ID: ENSP00000365309
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 906 - protein, 481 aa, Homo sapiens
  Payload ID: 151;
  Gene Symbol: ABI1;
  Gene Name: abl-interactor 1;
  Uniprot ID:  Q8IZP0;
  ENSP ID: ENSP00000365310
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 907 - protein, 508 aa, Homo sapiens
  Payload ID: 151;
  Gene Symbol: ABI1;
  Gene Name: abl-interactor 1;
  Uniprot ID:  Q8IZP0;
  ENSP ID: ENSP00000365312
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPENISVPPPSGAPPAPPLAPLLPVSTVIAAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 908 - protein, 475 aa, Homo sapiens
  Payload ID: 151;
  Gene Symbol: ABI1;
  Gene Name: abl-interactor 1;
  ENSP ID: ENSP00000365330
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 909 - protein, 446 aa, Homo sapiens
  Payload ID: 151;
  Gene Symbol: ABI1;
  Gene Name: abl-interactor 1;
  Uniprot ID:  Q8IZP0;
  ENSP ID: ENSP00000365336
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAPGSAPGSQYGTMTRQISRHNSTTSSTSSGGYRRTPSVTAQFSAQPHVNGGPLYSQNSIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 910 - protein, 451 aa, Homo sapiens
  Payload ID: 151;
  Gene Symbol: ABI1;
  Gene Name: abl-interactor 1;
  Uniprot ID:  Q8IZP0;
  ENSP ID: ENSP00000365340
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAPGSAPGSQYGTMTRQISRHNSTTSSTSSGGYRRTPSVTAQFSAQPHVNGGPLYSQNSIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 911 - protein, 393 aa, Homo sapiens
  Payload ID: 151;
  Gene Symbol: ABI1;
  Gene Name: abl-interactor 1;
  ENSP ID: ENSP00000439646
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPVADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 912 - protein, 329 aa, Homo sapiens
  Payload ID: 151;
  Gene Symbol: ABI1;
  Gene Name: abl-interactor 1;
  Uniprot ID:  Q8IZP0;
  ENSP ID: ENSP00000440101
MAELQMLLEEEIPSGKRALIESYQNLTRVADYCENNYIQATDKRKALEETKAYTTQSLASVAYQINALANNVLQLLDIQASQLRRMESSINHISQHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPVADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 913 - protein, 390 aa, Homo sapiens
  Payload ID: 152;
  Gene Symbol: ABI2;
  Gene Name: abl-interactor 2;
  ENSP ID: ENSP00000261016
MFFKSYLLKISILRQIRGVDLESTFVTKFGNNCSLRLNETVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 914 - protein, 475 aa, Homo sapiens
  Payload ID: 152;
  Gene Symbol: ABI2;
  Gene Name: abl-interactor 2;
  Uniprot ID:  Q9NYB9;
  ENSP ID: ENSP00000261017
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSLAPPPPSILQVTPQLPLMGFVARVQENISDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 915 - protein, 513 aa, Homo sapiens
  Payload ID: 152;
  Gene Symbol: ABI2;
  Gene Name: abl-interactor 2;
  ENSP ID: ENSP00000261018
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKWLLRFKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPAPAGSAGTPPLPATSASAPAPLVPATVPSSTAPDAAAGGAQTLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 916 - protein, 513 aa, Homo sapiens; identical to SEQ ID NO: 915
  Payload ID: 152;
  Gene Symbol: ABI2;
  Gene Name: abl-interactor 2;
  ENSP ID: ENSP00000295851

SEQ ID NO: 917 - protein, 507 aa, Homo sapiens
  Payload ID: 152;
  Gene Symbol: ABI2;
  Gene Name: abl-interactor 2;
  ENSP ID: ENSP00000391433
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPAPAGSAGTPPLPATSASAPAPLVPATVPSSTAPDAAAGGAQTLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 918 - protein, 480 aa, Homo sapiens
  Payload ID: 152;
  Gene Symbol: ABI2;
  Gene Name: abl-interactor 2;
  ENSP ID: ENSP00000396249
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKWLLRFKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPDAAAGGAQTLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 919 - protein, 75 aa, Homo sapiens
  Payload ID: 152;
  Gene Symbol: ABI2;
  Gene Name: abl-interactor 2;
  ENSP ID: ENSP00000397850
MAELQMLLEEEIPGGRRALFDSYTNLERVADYCENNYIQRWGLGMSCRLECSGVIIAHCSLELLCSSDHPASVSQ

SEQ ID NO: 920 - protein, 44 aa, Homo sapiens
  Payload ID: 152;
  Gene Symbol: ABI2;
  Gene Name: abl-interactor 2;
  ENSP ID: ENSP00000398487
MAELQMLLEEEIPGGRRALFDSYTNLERVADYCENNYIQISREP

SEQ ID NO: 921 - protein, 59 aa, Homo sapiens
  Payload ID: 152;
  Gene Symbol: ABI2;
  Gene Name: abl-interactor 2;
  ENSP ID: ENSP00000399040
MAELQMLLEEEIPGGRRALFDSYTNLERVADYCENNYIQAFRFDSAYPLVLPDKEYMES

SEQ ID NO: 922 - protein, 293 aa, Homo sapiens
  Payload ID: 152;
  Gene Symbol: ABI2;
  Gene Name: abl-interactor 2;
  ENSP ID: ENSP00000404352
  MOD_RES (1)..(1): Any amino acid
XVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 923 - protein, 53 aa, Homo sapiens
  Payload ID: 152;
  Gene Symbol: ABI2;
  Gene Name: abl-interactor 2;
  ENSP ID: ENSP00000405255
MAELQMLLEEEIPGGRRALFDSYTNLERVADYCENNYIQLLSIFPFCEVSVSR

SEQ ID NO: 924 - protein, 87 aa, Homo sapiens
  Payload ID: 152;
  Gene Symbol: ABI2;
  Gene Name: abl-interactor 2;
  ENSP ID: ENSP00000405801
MAELQMLLEEEIPGGRRALFDSYTNLERVADYCENNYIQSADKQRALEETKAYTTQSLASVAYLINTLANNVLQMLDIQVILYSSTA

SEQ ID NO: 925 - protein, 108 aa, Homo sapiens
  Payload ID: 152;
  Gene Symbol: ABI2;
  Gene Name: abl-interactor 2;
  ENSP ID: ENSP00000408334
MAELQMLLEEEIPGGRRALFDSYTNLERVADYCENNYIQSADKQRALEETKAYTTQSLASVAYLINTLANNVLQMLDIQASQLRRMESSINHISQMFSHTDGQLTEAN

SEQ ID NO: 926 - protein, 458 aa, Homo sapiens
  Payload ID: 152;
  Gene Symbol: ABI2;
  Gene Name: abl-interactor 2;
  ENSP ID: ENSP00000408898
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGSSGSSGGSHPSSRSSSRENSGSGSVGVPIAVPTPSPPSVFPAPAGSAGTPPLPATSASAPAPLVPATVPSSTAPDAAAGGAQTLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 927 - protein, 43 aa, Homo sapiens
  Payload ID: 152;
  Gene Symbol: ABI2;
  Gene Name: abl-interactor 2;
  ENSP ID: ENSP00000410509
  MOD_RES (1)..(1): Any amino acid
XQSLASVAYLINTLANNVLQMLDIQASQLRRMESSINHISQAN

SEQ ID NO: 928 - protein, 201 aa, Homo sapiens
  Payload ID: 152;
  Gene Symbol: ABI2;
  Gene Name: abl-interactor 2;
  ENSP ID: ENSP00000413375
  MOD_RES (1)..(1): Any amino acid
XLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNP

SEQ ID NO: 929 - protein, 486 aa, Homo sapiens
  Payload ID: 152;
  Gene Symbol: ABI2;
  Gene Name: abl-interactor 2;
  ENSP ID: ENSP00000414703
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKWLLRFKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPAPAGSAGTPPLPATSASAPAPLVPATVPSSTAPDAAAGGAQTLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDD

SEQ ID NO: 930 - protein, 1892 aa, Homo sapiens
  Payload ID: 153;
  Gene Symbol: ASPM;
  Gene Name: abnormal spindle microtubule assembly;
  Uniprot ID:  Q8IZT6;
  ENSP ID: ENSP00000294732
MANRRVGRGCWEVSPTERRPPAGLRGPAAEEEASSPPVLSLSHFCRSPFLCFGDVLLGASRTLSLALDNPNEEVAEVKISHFPAADLGFSVSQRCFVLQPKEKIVISVNWTPLKEGRVREIMTFLVNDVLKHQAILLGNAEEQKKKKRSLWDTIKKKKISASTSHNRRVSNIQNVNKTFSVSQKVDRVRSPLQACENLAMNEGGPPTENNSLILEENKIPISPISPAFNECHGATCLPLSVRRSTTYSSLHASENRELLNVHSANVSKVSFNEKAVTETSFNSVNVNGQRGENSKLSLTPNCSSTLNITQSQIHFLSPDSFVNNSHGANNELELVTCLSSDMFMKDNSQPVHLESTIAHEIYQKILSPDSFIKDNYGLNQDLESESVNPILSPNQFLKDNMAYMCTSQQTCKVPLSNENSQVPQSPEDWRKSEVSPRIPECQGSKSPKAIFEELVEMKSNYYSFIKQNNPKFSAVQDISSHSHNKQPKRRPILSATVTKRKATCTRENQTEINKPKAKRCLNSAVGEHEKVINNQKEKEDFHSYLPIIDPILSKSKSYKNEVTPSSTTASVARKRKSDGSMEDANVRVAITEHTEVREIKRIHFSPSEPKTSAVKKTKNVTTPISKRISNREKLNLKKKTDLSIFRTPISKTNKRTKPIIAVAQSSLTFIKPLKTDIPRHPMPFAAKNMFYDERWKEKQEQGFTWWLNFILTPDDFTVKTNISEVNAATLLLGIENQHKISVPRAPTKEEMSLRAYTARCRLNRLRRAACRLFTSEKMVKAIKKLEIEIEARRLIVRKDRHLWKDVGERQKVLNWLLSYNPLWLRIGLETTYGELISLEDNSDVTGLAMFILNRLLWNPDIAAEYRHPTVPHLYRDGHEEALSKFTLKKLLLLVCFLDYAKISRLIDHDPCLFCKDAEFKASKEILLAFSRDFLSGEGDLSRHLGLLGLPVNHVQTPFDEFDFAVTNLAVDLQCGVRLVRTMELLTQNWDLSKKLRIPAISRLQKMHNVDIVLQVLKSRGIELSDEHGNTILSKDIVDRHREKTLRLLWKIAFAFQVDISLNLDQLKEEIAFLKHTKSIKKTISLLSCHSDDLINKKKGKRDSGSFEQYSENIKLLMDWVNAVCAFYNKKVENFTVSFSDGRVLCYLIHHYHPCYVPFDAICQRTTQTVECTQTGSVVLNSSSESDDSSLDMSLKAFDHENTSELYKELLENEKKNFHLVRSAVRDLGGIPAMINHSDMSNTIPDEKVVITYLSFLCARLLDLRKEIRAARLIQTTWRKYKLKTDLKRHQEREKAARIIQLAVINFLAKQRLRKRVNAALVIQKYWRRVLAQRKLLMLKKEKLEKVQNKAASLIQAMWRRYRAKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKHERIKYIEFKKSTVILQALVRGWLVRKRFLEQRAKIRLLHFTAAAYYHLNAVRIQRAYKLYLAVKNANKQVNSVICIQRWFRARLQEKRFIQKYHSIKKIEHEGQECLSQRNRAASVIQKAVRHFLLRKKQEKFTSGIIKIQALWRGYSWRKKNDCTKIKAIRLSLQVVNREIREENKLYKRTALALHYLLTYKHLSAILEALKHLEVVTRLSPLCCENMAQSGAISKIFVLIRSCNRSIPCMEVIRYAVQVLLNVSKYEKTTSAVYDVENCIDILLELLQIYREKPGNKVADKGGSIFTKTCCLLAILLKTTNRASDVRSRSKVVDRIYSLYKLTAHKHKMNTERILYKQKKNSSISIPFIPETPVRTRIVSRLKPDWVLRRDNMEEITNPLQAIQMVMDTLGIPY

SEQ ID NO: 931 - protein, 1142 aa, Homo sapiens
  Payload ID: 153;
  Gene Symbol: ASPM;
  Gene Name: abnormal spindle microtubule assembly;
  ENSP ID: ENSP00000356378
MSLRAYTARCRLNRLRRAACRLFTSEKMVKAIKKLEIEIEARRLIVRKDRHLWKDVGERQKVLNWLLSYNPLWLRIGLETTYGELISLEDNSDVTGLAMFILNRLLWNPDIAAEYRHPTVPHLYRDGHEEALSKFTLKKLLLLVCFLDYAKISRLIDHDPCLFCKDAEFKASKEILLAFSRDFLSGEGDLSRHLGLLGLPVNHVQTPFDEFDFAVTNLAVDLQCGVRLVRTMELLTQNWDLSKKLRIPAISRLQKMHNVDIVLQVLKSRGIELSDEHGNTILSKDIVDRHREKTLRLLWKIAFAFQVDISLNLDQLKEEIAFLKHTKSIKKTISLLSCHSDDLINKKKGKRDSGSFEQYSENIKLLMDWVNAVCAFYNKKVENFTVSFSDGRVLCYLIHHYHPCYVPFDAICQRTTQTVECTQTGSVVLNSSSESDDSSLDMSLKAFDHENTSELYKELLENEKKNFHLVRSAVRDLGGIPAMINHSDMSNTIPDEKVVITYLSFLCARLLDLRKEIRAARLIQTTWRKYKLKTDLKRHQEREKAARIIQLAVINFLAKQRLRKRVNAALVIQKYWRRVLAQRKLLMLKKEKLEKVQNKAASLIQAMWRRYRAKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKHERIKYIEFKKSTVILQALVRGWLVRKRFLEQRAKIRLLHFTAAAYYHLNAVRIQRAYKLYLAVKNANKQVNSVICIQRWFRARLQEKRFIQKYHSIKKIEHEGQECLSQRNRAASVIQKAVRHFLLRKKQEKFTSGIIKIQALWRGYSWRKKNDCTKIKAIRLSLQVVNREIREENKLYKRTALALHYLLTYKHLSAILEALKHLEVVTRLSPLCCENMAQSGAISKIFVLIRSCNRSIPCMEVIRYAVQVLLNVSKYEKTTSAVYDVENCIDILLELLQIYREKPGNKVADKGGSIFTKTCCLLAILLKTTNRASDVRSRSKVVDRIYSLYKLTAHKHKMNTERILYKQKKNSSISIPFIPETPVRTRIVSRLKPDWVLRRDNMEEITNPLQAIQMVMDTLGIPY

SEQ ID NO: 932 - protein, 3477 aa, Homo sapiens
  Payload ID: 153;
  Gene Symbol: ASPM;
  Gene Name: abnormal spindle microtubule assembly;
  Uniprot ID:  Q8IZT6;
  ENSP ID: ENSP00000356379
MANRRVGRGCWEVSPTERRPPAGLRGPAAEEEASSPPVLSLSHFCRSPFLCFGDVLLGASRTLSLALDNPNEEVAEVKISHFPAADLGFSVSQRCFVLQPKEKIVISVNWTPLKEGRVREIMTFLVNDVLKHQAILLGNAEEQKKKKRSLWDTIKKKKISASTSHNRRVSNIQNVNKTFSVSQKVDRVRSPLQACENLAMNEGGPPTENNSLILEENKIPISPISPAFNECHGATCLPLSVRRSTTYSSLHASENRELLNVHSANVSKVSFNEKAVTETSFNSVNVNGQRGENSKLSLTPNCSSTLNITQSQIHFLSPDSFVNNSHGANNELELVTCLSSDMFMKDNSQPVHLESTIAHEIYQKILSPDSFIKDNYGLNQDLESESVNPILSPNQFLKDNMAYMCTSQQTCKVPLSNENSQVPQSPEDWRKSEVSPRIPECQGSKSPKAIFEELVEMKSNYYSFIKQNNPKFSAVQDISSHSHNKQPKRRPILSATVTKRKATCTRENQTEINKPKAKRCLNSAVGEHEKVINNQKEKEDFHSYLPIIDPILSKSKSYKNEVTPSSTTASVARKRKSDGSMEDANVRVAITEHTEVREIKRIHFSPSEPKTSAVKKTKNVTTPISKRISNREKLNLKKKTDLSIFRTPISKTNKRTKPIIAVAQSSLTFIKPLKTDIPRHPMPFAAKNMFYDERWKEKQEQGFTWWLNFILTPDDFTVKTNISEVNAATLLLGIENQHKISVPRAPTKEEMSLRAYTARCRLNRLRRAACRLFTSEKMVKAIKKLEIEIEARRLIVRKDRHLWKDVGERQKVLNWLLSYNPLWLRIGLETTYGELISLEDNSDVTGLAMFILNRLLWNPDIAAEYRHPTVPHLYRDGHEEALSKFTLKKLLLLVCFLDYAKISRLIDHDPCLFCKDAEFKASKEILLAFSRDFLSGEGDLSRHLGLLGLPVNHVQTPFDEFDFAVTNLAVDLQCGVRLVRTMELLTQNWDLSKKLRIPAISRLQKMHNVDIVLQVLKSRGIELSDEHGNTILSKDIVDRHREKTLRLLWKIAFAFQVDISLNLDQLKEEIAFLKHTKSIKKTISLLSCHSDDLINKKKGKRDSGSFEQYSENIKLLMDWVNAVCAFYNKKVENFTVSFSDGRVLCYLIHHYHPCYVPFDAICQRTTQTVECTQTGSVVLNSSSESDDSSLDMSLKAFDHENTSELYKELLENEKKNFHLVRSAVRDLGGIPAMINHSDMSNTIPDEKVVITYLSFLCARLLDLRKEIRAARLIQTTWRKYKLKTDLKRHQEREKAARIIQLAVINFLAKQRLRKRVNAALVIQKYWRRVLAQRKLLMLKKEKLEKVQNKAASLIQGYWRRYSTRQRFLKLKYYSIILQSRIRMIIAVTSYKRYLWATVTIQRHWRAYLRRKQDQQRYEMLKSSTLIIQSMFRKWKQRKMQSQVKATVILQRAFREWHLRKQAKEENSAIIIQSWYRMHKELRKYIYIRSCVVIIQKRFRCFQAQKLYKRRKESILTIQKYYKAYLKGKIERTNYLQKRAAAIQLQAAFRRLKAHNLCRQIRAACVIQSYWRMRQDRVRFLNLKKTIIKFQAHVRKHQQRQKYKKMKKAAVIIQTHFRAYIFAMKVLASYQKTRSAVIVLQSAYRGMQARKMYIHILTSVIKIQSYYRAYVSKKEFLSLKNATIKLQSTVKMKQTRKQYLHLRAAALFIQQCYRSKKIAAQKREEYMQMRESCIKLQAFVRGYLVRKQMRLQRKAVISLQSYFRMRKARQYYLKMYKAIIVIQNYYHAYKAQVNQRKNFLQVKKAATCLQAAYRGYKVRQLIKQQSIAALKIQSAFRGYNKRVKYQSVLQSIIKIQRWYRAYKTLHDTRTHFLKTKAAVISLQSAYRGWKVRKQIRREHQAALKIQSAFRMAKAQKQFRLFKTAALVIQQNFRAWTAGRKQCMEYIELRHAVLVLQSMWKGKTLRRQLQRQHKCAIIIQSYYRMHVQQKKWKIMKKAALLIQKYYRAYSIGREQNHLYLKTKAAVVTLQSAYRGMKVRKRIKDCNKAAVTIQSKYRAYKTKKKYATYRASAIIIQRWYRGIKITNHQHKEYLNLKKTAIKIQSVYRGIRVRRHIQHMHRAATFIKAMFKMHQSRISYHTMRKAAIVIQVRCRAYYQGKMQREKYLTILKAVKVLQASFRGVRVRRTLRKMQTAATLIQSNYRRYRQQTYFNKLKKITKTVQQRYWAMKERNIQFQRYNKLRHSVIYIQAIFRGKKARRHLKMMHIAATLIQRRFRTLMMRRRFLSLKKTAILIQRKYRAHLCTKHHLQFLQVQNAVIKIQSSYRRWMIRKRMREMHRAATFIQSTFRMHRLHMRYQALKQASVVIQQQYQANRAAKLQRQHYLRQRHSAVILQAAFRGMKTRRHLKSMHSSATLIQSRFRSLLVRRRFISLKKATIFVQRKYRATICAKHKLYQFLHLRKAAITIQSSYRRLMVKKKLQEMQRAAVLIQATFRMYRTYITFQTWKHASILIQQHYRTYRAAKLQRENYIRQWHSAVVIQAAYKGMKARQLLREKHKASIVIQSTYRMYRQYCFYQKLQWATKIIQEKYRANKKKQKVFQHNELKKETCVQAGFQDMNIKKQIQEQHQAAIIIQKHCKAFKIRKHYLHLRATVVSIQRRYRKLTAVRTQAVICIQSYYRGFKVRKDIQNMHRAATLIQSFYRMHRAKVDYETKKTAIVVIQNYYRLYVRVKTERKNFLAVQKSVRTIQAAFRGMKVRQKLKNVSEEKMAAIVNQSALCCYRSKTQYEAVQSEGVMIQEWYKASGLACSQEAEYHSQSRAAVTIQKAFCRMVTRKLETQKCAALRIQFFLQMAVYRRRFVQQKRAAITLQHYFRTWQTRKQFLLYRKAAVVLQNHYRAFLSAKHQRQVYLQIRSSVIIIQARSKGFIQKRKFQEIKNSTIKIQAMWRRYRAKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKHERIKYIEFKKSTVILQALVRGWLVRKRFLEQRAKIRLLHFTAAAYYHLNAVRIQRAYKLYLAVKNANKQVNSVICIQRWFRARLQEKRFIQKYHSIKKIEHEGQECLSQRNRAASVIQKAVRHFLLRKKQEKFTSGIIKIQALWRGYSWRKKNDCTKIKAIRLSLQVVNREIREENKLYKRTALALHYLLTYKHLSAILEALKHLEVVTRLSPLCCENMAQSGAISKIFVLIRSCNRSIPCMEVIRYAVQVLLNVSKYEKTTSAVYDVENCIDILLELLQIYREKPGNKVADKGGSIFTKTCCLLAILLKTTNRASDVRSRSKVVDRIYSLYKLTAHKHKMNTERILYKQKKNSSISIPFIPETPVRTRIVSRLKPDWVLRRDNMEEITNPLQAIQMVMDTLGIPY

SEQ ID NO: 933 - protein, 1389 aa, Homo sapiens
  Payload ID: 153;
  Gene Symbol: ASPM;
  Gene Name: abnormal spindle microtubule assembly;
  ENSP ID: ENSP00000479244
MANRRVGRGCWEVSPTERRPPAGLRGPAAEEEASSPPVLSLSHFCRSPFLCFGDVLLGASRTLSLALDNPNEEVAEVKISHFPAADLGFSVSQRCFVLQPKEKIVISVNWTPLKEGRVREIMTFLVNDVLKHQAILLGNAEEQKKKKRSLWDTIKKKKISASTSHNRRVSNIQNVNKTFSVSQKVDRRYRQQTYFNKLKKITKTVQQRYWAMKERNIQFQRYNKLRHSVIYIQAIFRGKKARRHLKMMHIAATLIQRRFRTLMMRRRFLSLKKTAILIQRKYRAHLCTKHHLQFLQVQNAVIKIQSSYRRWMIRKRMREMHRAATFIQSTFRMHRLHMRYQALKQASVVIQQQYQANRAAKLQRQHYLRQRHSAVILQAAFRGMKTRRHLKSMHSSATLIQSRFRSLLVRRRFISLKKATIFVQRKYRATICAKHKLYQFLHLRKAAITIQSSYRRLMVKKKLQEMQRAAVLIQATFRMYRTYITFQTWKHASILIQQHYRTYRAAKLQRENYIRQWHSAVVIQAAYKGMKARQLLREKHKASIVIQSTYRMYRQYCFYQKLQWATKIIQEKYRANKKKQKVFQHNELKKETCVQAGFQDMNIKKQIQEQHQAAIIIQKHCKAFKIRKHYLHLRATVVSIQRRYRKLTAVRTQAVICIQSYYRGFKVRKDIQNMHRAATLIQSFYRMHRAKVDYETKKTAIVVIQNYYRLYVRVKTERKNFLAVQKSVRTIQAAFRGMKVRQKLKNVSEEKMAAIVNQSALCCYRSKTQYEAVQSEGVMIQEWYKASGLACSQEAEYHSQSRAAVTIQKAFCRMVTRKLETQKCAALRIQFFLQMAVYRRRFVQQKRAAITLQHYFRTWQTRKQFLLYRKAAVVLQNHYRAFLSAKHQRQVYLQIRSSVIIIQARSKGFIQKRKFQEIKNSTIKIQAMWRRYRAKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKHERIKYIEFKKSTVILQALVRGWLVRKRFLEQRAKIRLLHFTAAAYYHLNAVRIQRAYKLYLAVKNANKQVNSVICIQRWFRARLQEKRFIQKYHSIKKIEHEGQECLSQRNRAASVIQKAVRHFLLRKKQEKFTSGIIKIQALWRGYSWRKKNDCTKIKAIRLSLQVVNREIREENKLYKRTALALHYLLTYKHLSAILEALKHLEVVTRLSPLCCENMAQSGAISKIFVLIRSCNRSIPCMEVIRYAVQVLLNVSKYEKTTSAVYDVENCIDILLELLQIYREKPGNKVADKGGSIFTKTCCLLAILLKTTNRASVSISQLPFFKIIFLWS

SEQ ID NO: 934 - protein, 373 aa, Homo sapiens
  Payload ID: 154;
  Gene Symbol: ABO;
  Gene Name: ABO blood group (transferase A, alpha 1-3-N-acetylgalactosaminyltransferase;
  transferase B, alpha 1-3-galactosyltransferase);
  ENSP ID: ENSP00000483018
MAEVLRTLAGKPKCHALRPMILFLIMLVLVLFGYGVLSPRSLMPGSLERGFCMAVREPDHLQRVSLPRMVYPQPKVLTPCRKDVLVTPWLAPIVWEGTFNIDILNEQFRLQNTTIGLTVFAIKKYVAFLKLFLETAEKHFMVGHRVHYYVFTDQPAAVPRVTLGTGRQLSVLEVRAYKRWQDVSMRRMEMISDFCERRFLSEVDYLVCVDVDMEFRDHVGVEILTPLFGTLHPGFYGSSREAFTYERRPQSQAYIPKDEGDFYYLGGFFGGSVQEVQRLTRACHQAMMVDQANGIEAVWHDESHLNKYLLRHKPTKVLSPEYLWDQQLLGWPAVLRKLRFTAVPKNHQAVRRERLPGALGGLPAAPSPSRPWF

SEQ ID NO: 935 - protein, 353 aa, Homo sapiens
  Payload ID: 154;
  Gene Symbol: ABO;
  Gene Name: ABO blood group (transferase A, alpha 1-3-N-acetylgalactosaminyltransferase;
  transferase B, alpha 1-3-galactosyltransferase);
  ENSP ID: ENSP00000483265
MAEVLRTLAGKPKCHALRPMILFLIMLVLVLFGYGVLSPRSLMPGSLERGFCMAVREPDHLQRVSLPRMVYPQPKVLTPCRKDVLVTPWLAPIVWEGTFNIDILNEQFRLQNTTIGLTVFAIKKYVAFLKLFLETAEKHFMVGHRVHYYVFTDQPAAVPRVTLGTGRQLSVLEVRAYKRWQDVSMRRMEMISDFCERRFLSEVDYLVCVDVDMEFRDHVGVEILTPLFGTLHPGFYGSSREAFTYERRPQSQAYIPKDEGDFYYLGGFFGGSVQEVQRLTRACHQAMMVDQANGIEAVWHDESHLNKYLLRHKPTKVLSPEYLWDQQLLGWPAVLRKLRFTAVPKNHQAVRNP

SEQ ID NO: 936 - protein, 81 aa, Homo sapiens
  Payload ID: 155;
  Gene Symbol: ABRACL;
  Gene Name: ABRA C-terminal like;
  Uniprot ID:  Q9P1F3;
  ENSP ID: ENSP00000356632
MNVDHEVNLLVEEIHRLGSKNADGKLSVKFGVLFRDDKCANLFEALVGTLKAAKRRKIVTYPGELLLQGVHDDVDIILLQD

SEQ ID NO: 937 - protein, 67 aa, Homo sapiens
  Payload ID: 155;
  Gene Symbol: ABRACL;
  Gene Name: ABRA C-terminal like;
  ENSP ID: ENSP00000418406
MNVDHEVNLLVEEIHRLGSKSKYLTEIEYFSWLYLGTGETGMLEKPMKGSPRASGHRSGSSAHSPRL

SEQ ID NO: 938 - protein, 1723 aa, Homo sapiens
  Payload ID: 156;
  Gene Symbol: AIM1;
  Gene Name: absent in melanoma 1;
  Uniprot ID:  Q9Y4K1;
  ENSP ID: ENSP00000358062
MEKRSSGRRSGRRRGSQKSTDSPGADAELPESAARDDAVFDDEVAPNAASDNASAEKKVKSPRAALDGGVASAASPESKPSPGTKGQLRGESDRSKQPPPASSPTKRKGRSRALEAVPAPPASGPRAPAKESPPKRVPDPSPVTKGTAAESGEEAARAIPRELPVKSSSLLPEIKPEHKRGPLPNHFNGRAEGGRSRELGRAAGAPGASDADGLKPRNHFGVGRSTVTTKVTLPAKPKHVELNLKTPKNLDSLGNEHNPFSQPVHKGNTATKISLFENKRTNSSPRHTDIRGQRNTPASSKTFVGRAKLNLAKKAKEMEQPEKKVMPNSPQNGVLVKETAIETKVTVSEEEILPATRGMNGDSSENQALGPQPNQDDKADVQTDAGCLSEPVASALIPVKDHKLLEKEDSEAADSKSLVLENVTDTAQDIPTTVDTKDLPPTAMPKPQHTFSDSQSPAESSPGPSLSLSAPAPGDVPKDTCVQSPISSFPCTDLKVSENHKGCVLPVSRQNNEKMPLLELGGETTPPLSTERSPEAVGSECPSRVLVQVRSFVLPVESTQDVSSQVIPESSEVREVQLPTCHSNEPEVVSVASCAPPQEEVLGNEHSHCTAELAAKSGPQVIPPASEKTLPIQAQSQGSRTPLMAESSPTNSPSSGNHLATPQRPDQTVTNGQDSPASLLNISAGSDDSVFDSSSDMEKFTEIIKQMDSAVCMPMKRKKARMPNSPAPHFAMPPIHEDHLEKVFDPKVFTFGLGKKKESQPEMSPALHLMQNLDTKSKLRPKRASAEQSVLFKSLHTNTNGNSEPLVMPEINDKENRDVTNGGIKRSRLEKSALFSSLLSSLPQDKIFSPSVTSVNTMTTAFSTSQNGSLSQSSVSQPTTEGAPPCGLNKEQSNLLPDNSLKVFNFNSSSTSHSSLKSPSHMEKYPQKEKTKEDLDSRSNLHLPETKFSELSKLKNDDMEKANHIESVIKSNLPNCANSDTDFMGLFKSSRYDPSISFSGMSLSDTMTLRGSVQNKLNPRPGKVVIYSEPDVSEKCIEVFSDIQDCSSWSLSPVILIKVVRGCWILYEQPNFEGHSIPLEEGELELSGLWGIEDILERHEEAESDKPVVIGSIRHVVQDYRVSHIDLFTEPEGLGILSSYFDDTEEMQGFGVMQKTCSMKVHWGTWLIYEEPGFQGVPFILEPGEYPDLSFWDTEEAYIGSMRPLKMGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLDSFTGPRRRNQIHLFSEPQFQGHSQSFEETTSQIDDSFSTKSCRVSGGSWVVYDGENFTGNQYVLEEGHYPCLSAMGCPPGATFKSLRFIDVEFSEPTIILFEREDFKGKKIELNAETVNLRSLGFNTQIRSVQVIGGIWVTYEYGSYRGRQFLLSPAEVPNWYEFSGCRQIGSLRPFVQKRIYFRLRNKATGLFMSTNGNLEDLKLLRIQVMEDVGADDQIWIYQEGCIKCRIAEDCCLTIVGSLVTSGSKLGLALDQNADSQFWSLKSDGRIYSKLKPNLVLDIKGGTQYDQNHIILNTVSKEKFTQVWEAMVLYT

SEQ ID NO: 939 - protein, 316 aa, Homo sapiens
  Payload ID: 156;
  Gene Symbol: AIM1;
  Gene Name: absent in melanoma 1;
  ENSP ID: ENSP00000391419
MQKPKTVAWENLGPEMSALGTAFSREGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLDSFTGPRRRNQIHLFSEPQFQGHSQSFEETTSQIDDSFSTKSCRVSGGSWVVYDGENFTGNQYVLEEGHYPCLSAMGCPPGATFKSLRFIDV

SEQ ID NO: 940 - protein, 2131 aa, Homo sapiens
  Payload ID: 156;
  Gene Symbol: AIM1;
  Gene Name: absent in melanoma 1;
  ENSP ID: ENSP00000488010
MPLSPPAQGDPGEPSPCRPPKKHTTFHLWRSKKKQQPAPPDCGVFVPHPLPAPAGEARALDVVDGKYVVRDSQEFPLHCGESQFFHTTSEALGSLLLESGIFKKSRAQPPEDNRRKPVLGKLGTLFTAGRRRNSRNGLESPTRSNAKPLSPKDVVASPKLPERESERSRSQSSQLKQTDTSEEGSPRENPREAEGELPESGGPAAPPDAELSPRWSSSAAAVAVQQCHENDSPQLEPLEAEGEPFPDATTTAKQLHSSPGNSSRQENAETPARSPGEDASPGAGHEQEAFLGVRGAPGSPTQERPAGGLGEAPNGAPSVCAEEGSLGPRNARSQPPKGASDLPGEPPAEGAAHTASSAQADCTARPKGHAHPAKVLTLDIYLSKTEGAQVDEPVVITPRAEDCGDWDDMEKRSSGRRSGRRRGSQKSTDSPGADAELPESAARDDAVFDDEVAPNAASDNASAEKKVKSPRAALDGGVASAASPESKPSPGTKGQLRGESDRSKQPPPASSPTKRKGRSRALEAVPAPPASGPRAPAKESPPKRVPDPSPVTKGTAAESGEEAARAIPRELPVKSSSLLPEIKPEHKRGPLPNHFNGRAEGGRSRELGRAAGAPGASDADGLKPRNHFGVGRSTVTTKVTLPAKPKHVELNLKTPKNLDSLGNEHNPFSQPVHKGNTATKISLFENKRTNSSPRHTDIRGQRNTPASSKTFVGRAKLNLAKKAKEMEQPEKKVMPNSPQNGVLVKETAIETKVTVSEEEILPATRGMNGDSSENQALGPQPNQDDKADVQTDAGCLSEPVASALIPVKDHKLLEKEDSEAADSKSLVLENVTDTAQDIPTTVDTKDLPPTAMPKPQHTFSDSQSPAESSPGPSLSLSAPAPGDVPKDTCVQSPISSFPCTDLKVSENHKGCVLPVSRQNNEKMPLLELGGETTPPLSTERSPEAVGSECPSRVLVQVRSFVLPVESTQDVSSQVIPESSEVREVQLPTCHSNEPEVVSVASCAPPQEEVLGNEHSHCTAELAAKSGPQVIPPASEKTLPIQAQSQGSRTPLMAESSPTNSPSSGNHLATPQRPDQTVTNGQDSPASLLNISAGSDDSVFDSSSDMEKFTEIIKQMDSAVCMPMKRKKARMPNSPAPHFAMPPIHEDHLEKVFDPKVFTFGLGKKKESQPEMSPALHLMQNLDTKSKLRPKRASAEQSVLFKSLHTNTNGNSEPLVMPEINDKENRDVTNGGIKRSRLEKSALFSSLLSSLPQDKIFSPSVTSVNTMTTAFSTSQNGSLSQSSVSQPTTEGAPPCGLNKEQSNLLPDNSLKVFNFNSSSTSHSSLKSPSHMEKYPQKEKTKEDLDSRSNLHLPETKFSELSKLKNDDMEKANHIESVIKSNLPNCANSDTDFMGLFKSSRYDPSISFSGMSLSDTMTLRGSVQNKLNPRPGKVVIYSEPDVSEKCIEVFSDIQDCSSWSLSPVILIKVVRGCWILYEQPNFEGHSIPLEEGELELSGLWGIEDILERHEEAESDKPVVIGSIRHVVQDYRVSHIDLFTEPEGLGILSSYFDDTEEMQGFGVMQKTCSMKVHWGTWLIYEEPGFQGVPFILEPGEYPDLSFWDTEEAYIGSMRPLKMGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLDSFTGPRRRNQIHLFSEPQFQGHSQSFEETTSQIDDSFSTKSCRVSGGSWVVYDGENFTGNQYVLEEGHYPCLSAMGCPPGATFKSLRFIDVEFSEPTIILFEREDFKGKKIELNAETVNLRSLGFNTQIRSVQVIGGIWVTYEYGSYRGRQFLLSPAEVPNWYEFSGCRQIGSLRPFVQKRIYFRLRNKATGLFMSTNGNLEDLKLLRIQVMEDVGADDQIWIYQEGCIKCRIAEDCCLTIVGSLVTSGSKLGLALDQNADSQFWSLKSDGRIYSKLKPNLVLDIKGGTQYDQNHIILNTVSKEKFTQVWEAMVLYT

SEQ ID NO: 941 - protein, 1661 aa, Homo sapiens
  Payload ID: 157;
  Gene Symbol: AIM1L;
  Gene Name: absent in melanoma 1-like;
  Uniprot ID:  Q8N1P7;
  ENSP ID: ENSP00000310435
MEEAGGPMARAKARVVSATLTWRQRPPTQEEIKHGFHKVSLVSGAQMEAPQKEMFEFSRREEVEVNGFATQEEETVNCQGPRDTAGSKNFQSHGPIFSKKYIPPPKEKRPEGRLKEAVDQSDGSRQAPRTEPPCVGAMARTELLVPLPGPREPSPHPGVGLTSGSSRSLEEYRVTRTVRTTTVVGGHVDRRMSSSVTVRPVSSGEALPRGRQVSRMVPPVVVGSPPGSPSRSQAVKVLSNLVPAGHSPPASHLPRPTAGGPRSTGLGSTVGAALRQLPETGTAELKDSSALASTGIPASAHLPKNQDAPAACPDRDQGRAPDARACELWQVLGAPSSTELPLQTSQGQASVPSSPRLETHVPSPGLTHPAKQPVVPTHPGARLTPLVLPPKKKDGPVDPPAATVLPMVRSEHVTVPGQPPAPSTTRRKDVPSPGGLSAPSSPRNKFVQNSENVPVLPFTQREVVKGPGAPAASSPTRKEVVQGSSASAASSPTWKEVVKGPGAPAASSPTQKEVVQGSSAPAALFPTWKEVVKGPGAPDASFPTWKEVVKGPGAPAASSPTQKEVVQGSGAPAALSTTPKEVVKGPGAPAASSPTQKEVVKGPCAPAASSPTQKEVVQGSGAPAALSPKSTEVVQGPKGSSSIQKEAVQGIAGSLAPPLTKEETVQGPIAPATSLPKQDKGVQDSEGSPISSLTQKEVVQDPDALPAPSSSVDRVSPSPGGTPAPVPTGAEASTESQLVSDPTEGKTCTETSREEDEVALAADLEIFLDTLRSMEPPEILRTHRLPRAPRSSYLSMYATLPAIEEDQLGPWVLGPGPQEVPSLEEKEEEEEEEPENPYLSDDEKLQRRQEKAGPSPSRDLHPARPTQVSCSPLEMMKKHVAGTKGPHSELGLELQGGSRPTSRLGGSLLFGSLVPTAKEASTPEPLGTKLSALLPHGAPGLRKVPGQLPLLCSERSSPTEKLACSLPLEGWSPALKTQGKLNTRPGKVIFFSESGCQGSGREVWGDIVDASGWAPVASIRVVRGCWVLYEEPEFRGQKLVLPEGDMELRTPGTKWSPQGIGSLRRVVWDYSTPEISLFSEEGLKGEQVKLTEALKNSQGLEKPLQVASATVSAGLWLLYPKPLFEDTPYILEPGEYPTSEAWGTSDPSVGSLKPMRLGCPSVEKPGEPRAVVYEAPGFQGRSWEVSRDIYNLQQPEDSQSPHLASVGSLRVLGGCWVGYEKEGFRGHQYLLEEGEYPDWSHWGGYDELLTSLRVIRTDFGDPAVVLFEAMDFEGHGVEVSKALPDVELVQHGPSTQAIHVLSGVWVAYQEVGFSGEQYVLEKGVYRNCEDWGAGNSTLASLQPVLQVGEHDLHFVSKIQLFSRPDFLGDHFSFEDDQAALPASFRPQSCRVHGGSWILFDETNFEGDQHILSEGEFPTLTAMGCLASTVLGSLQKVSLHFSEPSIFLYGLECFEGKEIELSREVRSLQAEGFNNHVLSVRIKGGIWVLCEHSDFRGRQWLVGSCEITNWLTYSGTQRVGSLYPIKQRRVYFRLWNAALGGFLAVPDHVEDMKAGRVVVADPQAGGSCIWYYEDGLLKNQMAPTMSLQVIGPPSPGSKVVLWAESRLPRQTWSISESGHICSQMFEGQILDVKGGRGYDRDHVVLWEPDEDRASQIWTIHVL

SEQ ID NO: 942 - protein, 352 aa, Homo sapiens
  Payload ID: 157;
  Gene Symbol: AIM1L;
  Gene Name: absent in melanoma 1-like;
  ENSP ID: ENSP00000363323
MEEAGGPMARAKARVDGPVDPPAATVLPMVRSEHVTVPGQPPAPSTTRRKDVPSPGVDRVSPSPGGTPAPVPTGAEASTESQLVSDPTEGKTCTETSREEDEVALAADLEIFLDTLRSMEPPEILRTHRLPRAPRSSYLSMYATLPAIEEDQLGPWVLGPGPQEVPSLEEKEEEEEEEPENPYLSDDEKLQRRQEKAGPSPSRDLHPARPTQVSCSPLEMMKKHVAGTKGPHSELGLELQGGSRPTSRLGGSLLFGSLVPTAKEASTPEPLGTKLSALLPHGAPGLRKVPGQLPLLCSERSSPTEKLACSLPLEGWPSLKDPGQAEHQAWKGDLLLRVWLPRQWQGGLGRHR

SEQ ID NO: 943 - protein, 296 aa, Homo sapiens
  Payload ID: 157;
  Gene Symbol: AIM1L;
  Gene Name: absent in melanoma 1-like;
  ENSP ID: ENSP00000409834
  MOD_RES (1)..(1): Any amino acid
XSQGLEKPLQVASATVSAGLWLLYPKPLFEDTPYILEPGEYPTSEAWGTSDPSVGSLKPMRLAVVYEAPGFQGRSWEVSRDIYNLQQPEDSQSPHLASVGSLRVLGGCWVGYEKEGFRGHQYLLEEGEYPDWSHWGGYDELLTSLRVIRTDFGDPAVVLFEAMDFEGHGVEVSKALPDVELVQHGPSTQAIHVLSGVWVAYQEVGFSGEQYVLEKGVYRNCEDWGAGNSTLASLQPVLQVGEHDLHFVSKIQLFSRPDFLGDHFSFEDDQAALPASFRPQSCRVHGGSWILFDETN

SEQ ID NO: 944 - protein, 466 aa, Homo sapiens
  Payload ID: 157;
  Gene Symbol: AIM1L;
  Gene Name: absent in melanoma 1-like;
  ENSP ID: ENSP00000428746
MEEAGGPMARAKARVVSATLTWRQRPPTQEEIKHGFHKVSLVSGAQMEAPQKEMFEFSRREEVEVNGFATQEEETVNCQGPRDTAGSKNFQSHGPIFSKKYIPPPKEKRPEGRLKEAVDQSDGSRQAPRTEPPCVGAMARTELLVPLPGPREPSPHPGVGLTSGSSRSLEEYRVTRTVRTTTVVGGHVDRRMSSSVTVRPVSSGEALPRGRQVSRMVPPVVVGSPPGSPSRSQAVKVLSNLVPAGHSPPASHLPRPTAGGPRSTGLGSTVGAALRQLPETGTAELKDSSALASTGIPASAHLPKNQDAPAACPDRDQGRAPDARACELWQVLGAPSSTELPLQTSQGQASVPSSPRLETHVPSPGLTHPAKQPVVPTHPGARLTPLVLPPKKKDGPVDPPAATVLPMVRSEHVTVPGQPPAPSTTRRKDVPSPGGLSAPSSPRNKFVQNSENVPVLPFTQREVVKG

SEQ ID NO: 945 - protein, 787 aa, Homo sapiens [sequence omitted]

SEQ ID NO: 946 - protein, 167 aa, Homo sapiens
  Payload ID: 158;
  Gene Symbol: AIM2;
  Gene Name: absent in melanoma 2;
  ENSP ID: ENSP00000357111
MVAQQESIREGFQKRCLPVMVLKAKKPFTFETQEGKQEMFHATVATEKEFFFVKVFNTLLKDKFIPKRIIIIARYYRHSGFLEVNSASRVLDAESDQKVNVPLNIIRKAGETPKINTLQTQPLGTIVNGLFVVQKVTEKKKNILFDLSDNTGKMEVLGVRNEDTMKC

SEQ ID NO: 947 - protein, 343 aa, Homo sapiens
  Payload ID: 158;
  Gene Symbol: AIM2;
  Gene Name: absent in melanoma 2;
  Uniprot ID:  O14862;
  ENSP ID: ENSP00000357112
MESKYKEILLLTGLDNITDEELDRFKFFLSDEFNIATGKLHTANRIQVATLMIQNAGAVSAVMKTIRIFQKLNYMLLAKRLQEEKEKVDKQYKSVTKPKPLSQAEMSPAASAAIRNDVAKQRAAPKVSPHVKPEQKQMVAQQESIREGFQKRCLPVMVLKAKKPFTFETQEGKQEMFHATVATEKEFFFVKVFNTLLKDKFIPKRIIIIARYYRHSGFLEVNSASRVLDAESDQKVNVPLNIIRKAGETPKINTLQTQPLGTIVNGLFVVQKVTEKKKNILFDLSDNTGKMEVLGVRNEDTMKCKEGDKVRLTFFTLSKNGEKLQLTSGVHSTIKVIKAKKKT

SEQ ID NO: 948 - protein, 355 aa, Homo sapiens
  Payload ID: 158;
  Gene Symbol: AIM2;
  Gene Name: absent in melanoma 2;
  ENSP ID: ENSP00000483485
MESKYKEILLLTGLDNITDEELDRFKFFLSDEFNIATGKLHTANRIQVATLMIQNAGAVSAVMKTIRIFQKLNYMLLAKRLQEEKEKVDKQYKSVTKPKPLSQAEMSPAASAAIRNDVAKQRAAPKVSPHVKPEQKQMVAQQESIREGFQKRCLPVMVLKAKKPFTFETQEGKQEMFHATVATEKEFFFVKVFNTLLKDKFIPKRIIIIARYYRHSGFLEVNSASRVLDAESDQKVNVPLNIIRKAGETPKINTLQTQPLGTIVNGLFVVQKVTEKKKNILFDLSDNTGKMEVLGVRNEDTMKCKEGDKVRLTFFTLSKNGEKLQLTSGVHSTIKVIKAKKKHREVKRTNSSQLV

SEQ ID NO: 949 - protein, 330 aa, Homo sapiens
  Payload ID: 159;
  Gene Symbol:;
  Gene Name: AC002310.11;
  ENSP ID: ENSP00000454241
MTDPSLGLTVPMAPPLAPLPPRDPNGAGSEWRKPGAVSFADVAVYFSREEWGCLRPAQRALYRDVMRETYGHLGALGVGGSKPALISWVEEKAELWDPAAQDPEVAKCPTEADPDSRNKEEERQREGTGALEKPDPVAAGSPGLKAPQAPFAGLEQLSKARRRSRPRFFAHPPVPRADQRHGCYVCGKSFAWRSTLVEHIYSHRGEKPFHCADCGKGFGHASSLSKHRAIHRGERPHRCPECGRAFMRRTALTSHLRVHTGEKPYRCPQCGRCFGLKTGMAKHQWVHRPGGEGRRGRRPGGLSVTLTPVRGDLDPPVGFQLYPEIFQECG

SEQ ID NO: 950 - protein, 93 aa, Homo sapiens
  Payload ID: 160;
  Gene Symbol:;
  Gene Name: AC002310.13;
  ENSP ID: ENSP00000455659
MAPPLAPLPPRDPNGAGPEWREPGAVSFADVAVYFCREEWGCLRPAQRALYRDVMRETYGHLSALGVGGSKPALISWVEEKAELWDPAAQDPE

SEQ ID NO: 951 - protein, 55 aa, Homo sapiens
  Payload ID: 161;
  Gene Symbol:;
  Gene Name: AC002398.9;
  ENSP ID: ENSP00000468389
MNLERVSNEEKLNLCRKYYLGGFAFLPFLWLVNIFWFFREAFLVPAYTEQSQIKG

SEQ ID NO: 952 - protein, 84 aa, Homo sapiens
  Payload ID: 162;
  Gene Symbol:;
  Gene Name: AC002985.3;
  ENSP ID: ENSP00000469669
  MOD_RES (1)..(1): Any amino acid
XQEVKEAARLAREKSQDGGELTSPALGLASHQVPPSPLVSANGPGEEKLFRSQSADAPGPTERERLKKMLSEGWLSWRLRQLQR

SEQ ID NO: 953 - protein, 84 aa, Homo sapiens; identical to SEQ ID NO: 952
  Payload ID: 162;
  Gene Symbol:;
  Gene Name: AC002985.3;
  ENSP ID: ENSP00000471765
  MOD_RES (1)..(1): Any amino acid

SEQ ID NO: 954 - protein, 102 aa, Homo sapiens
  Payload ID: 163;
  Gene Symbol:;
  Gene Name: AC003002.4;
  ENSP ID: ENSP00000472894
MAEMNPAQGHVVFEDVAIYFSQEEWGHLDEAQRLLYRDVMLENLALLSSLGSWHGAEDEEAPSQQGFSVGVSEVTASKPCLSSQKVHPSETCGPPLKDILCL

SEQ ID NO: 955 - protein, 106 aa, Homo sapiens
  Payload ID: 164;
  Gene Symbol:;
  Gene Name: AC003002.6;
  ENSP ID: ENSP00000471870
MNLTEGPLAMAEMDPTQGRVVFEDVAIYFSQEEWGHLDEAQRLLYRDVMLENLALLSSLGFIAVAAMLMDAGQDYMVFEDVAIHFSQEEWGILNDVQRHLHSDVML

SEQ ID NO: 956 - protein, 179 aa, Homo sapiens
  Payload ID: 164;
  Gene Symbol:;
  Gene Name: AC003002.6;
  ENSP ID: ENSP00000472277
MNLTEGPLAMAEMDPTQDYMVFEDVAIHFSQEEWGILNDVQRHLHSDVMLENFALLSSVGCWHGAKDEEAPSKQCVSVGVSQVTTLKPALSTQKAQPCETCSSLLKDILHLAEHDGTHPKRTAKLYLHQKEHLREKLTRSDEGRPSFVNDSVHLAKRNLTCMQGGKDFTGDSDLQQQAL

SEQ ID NO: 957 - protein, 59 aa, Homo sapiens
  Payload ID: 165;
  Gene Symbol:;
  Gene Name: AC003005.4;
  ENSP ID: ENSP00000471625
MAAAALRDPAQGYVTFEDVAVYFSQEEWRLLDDAQRLLYRNVMLENFTLLASLAGLCDL

SEQ ID NO: 958 - protein, 58 aa, Homo sapiens
  Payload ID: 165;
  Gene Symbol:;
  Gene Name: AC003005.4;
  ENSP ID: ENSP00000472846
MAAAALRDPAQGYVTFEDVAVYFSQEEWRLLDDAQRLLYRNVMLENFTLLASLGLCDL

SEQ ID NO: 959 - protein, 148 aa, Homo sapiens
  Payload ID: 166;
  Gene Symbol:;
  Gene Name: AC003006.7;
  ENSP ID: ENSP00000472160
MAAVALRDSAQGTVTFEDVAVNFSQEEWSLLSEAQRCLYHDVMLENLTLISSLGCWYGAKDETPSKQTLSIQQESPLRTHWTGVCTKKVHLWGMCGPLLGDILHQGTQHNQKLNGFGAYEKKLDDDANHHQDQKQHIGEKSYRSNAKG

SEQ ID NO: 960 - protein, 72 aa, Homo sapiens
  Payload ID: 167;
  Gene Symbol:;
  Gene Name: AC004076.7;
  ENSP ID: ENSP00000472152
  MOD_RES (1)..(1): Any amino acid
XQGPLAMAEMDPTQRQDLTLSPKLEYSGMIIAHCHLEPLGSSDPPASASQVAGTTGRKNEGRDQLSMPLEAI

SEQ ID NO: 961 - protein, 132 aa, Homo sapiens
  Payload ID: 168;
  Gene Symbol:;
  Gene Name: AC004076.9;
  ENSP ID: ENSP00000470969
MAAAEPMGPAQVPMNSEVIVDPIQGQVNFEDVFVYFSQEEWVLLDEAQRLLYRDVMLENFALMASLGIPQTMAAFGLKYLLNDTGYTSSKSNTITATDSPADLPRKPEPHTPSWSWKKQAMSIRTVLWHPTG

SEQ ID NO: 962 - protein, 124 aa, Homo sapiens [sequence omitted]

SEQ ID NO: 963 - protein, 394 aa, Homo sapiens
  Payload ID: 170;
  Gene Symbol:;
  Gene Name: AC004231.7;
  ENSP ID: ENSP00000459812
MSYSCCLPSLGCRTSCSSRPCVPPSCHGYTLPGACNIPANVSNCNWFCEGSFNGSEKETMQFLNDRLASYLEKVRQLERDNAELEKLIQERSQQQEPLLCPSYQSYFKTIEELQQKILCAKAENARLVVNIDNAKLASDDFRSKYQTEQSLRLLVESDINSIRRILDELTLCKSDLESQVESLREELICLKKNHEEEVNTLRSQLGDRLNVEVDTAPTVDLNQVLNETRSQYEALVETNRREVEQWFATQTEELNKQVVSSSEQLQSCQAEIIELRRTVNALEIELQAQHNLRDSLENTLTESEAHYSSQLSQVQSLITNVESQLAEIRCDLERQNQEYQVLLDVRARLECEINTYRSLLESEDCKLPCNPCATTNASGNSCGPCGTSQKGCCN

SEQ ID NO: 964 - protein, 153 aa, Homo sapiens
  Payload ID: 171;
  Gene Symbol:;
  Gene Name: AC004556.1;
  ENSP ID: ENSP00000478035
MARNVVYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLAHGQTFTFPDLFPEKDESPEGSTADDLYSMLEEERQQRQSSDPRRGGVPSWFGL

SEQ ID NO: 965 - protein, 531 aa, Homo sapiens
  Payload ID: 172;
  Gene Symbol:;
  Gene Name: AC004754.3;
  ENSP ID: ENSP00000471331
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRKPIFGRYKPDTLAVAVENGTGTDRQILFLDLGTGAVLCSLALPSLPGGPLSASLPTADHRSAFFFWGLHELGSTSETETGEARHSLYMFHPTLPRVLLELANVSTHIVAFDGSHWATAERLLDGAELAPRPACPRLVTGVWEAARLCILLPGIRWLIYWF

SEQ ID NO: 966 - protein, 124 aa, Homo sapiens
  Payload ID: 173;
  Gene Symbol:;
  Gene Name: AC004813.1;
  ENSP ID: ENSP00000485143
MTLKEHAAFKHLFNKAHLAPPLIHLTLSGHSTCFREHRVGDKVTDQQDPKAEEFFLVQNKMKSLPCLLLSTQTRQPSDFSIFSPPFPPFYSTKPPLSSWPVLNELLGTPPRRGGGRAEGLLTSQ

SEQ ID NO: 967 - protein, 63 aa, Homo sapiens
  Payload ID: 174;
  Gene Symbol:;
  Gene Name: AC004824.2;
  ENSP ID: ENSP00000485570
TGARHYAQLIFVFLIEMGFHRVGQAGLKLLTSGDPPASASQSAGITGVSHCARPGQFIILRYL

SEQ ID NO: 968 - protein, 63 aa, Homo sapiens; identical to SEQ ID NO: 967
  Payload ID: 175;
  Gene Symbol:;
  Gene Name: AC004824.3;
  ENSP ID: ENSP00000485939

SEQ ID NO: 969 - protein, 317 aa, Homo sapiens
  Payload ID: 176;
  Gene Symbol:;
  Gene Name: AC004853.1;
  ENSP ID: ENSP00000485535
MGTDNQTWVSEFILLGLSSDWDTRVSLFVLFLVMYVVTVLGNCLIVLLIRLDSRLHTPMYFFLTNLSLVDVSYATSVVPQLLAHFLAEHKAIPFQSCAAQLFFSLALGGIEFVLLAVMAYDRYVAVCDALRYSAIMHGGLCARLAITSWVSGFISSPVQTAITFQLPMCRNKFIDHISCELLAVVRLACVDTSSNEVTIMVSSIVLLMTPFCLVLLSYIQIISTILKIQSREGRKKAFHTCASHLTVVALCYGVAIFTYIQPHSSPSVLQEKLFSVFYAILTPMLNPMIYSLRNKEVKGAWQKLLWKFSGLTSKLAT

SEQ ID NO: 970 - protein, 91 aa, Homo sapiens
  Payload ID: 177;
  Gene Symbol:;
  Gene Name: AC004953.1;
  ENSP ID: ENSP00000485307
MLLRLTSNSWAQTILPPQPPKVLGLQVPGNSWDRGEGSVGAQVRRMVDSRDQQSFSDLNALSPRLECSGMISAHCNLCLQGSSDSLVSASQ

SEQ ID NO: 971 - protein, 13 aa, Homo sapiens
  Payload ID: 178;
  Gene Symbol:;
  Gene Name: AC005042.1;
  ENSP ID: ENSP00000486420
LPPPSQSLLVEEG

SEQ ID NO: 972 - protein, 82 aa, Homo sapiens
  Payload ID: 179;
  Gene Symbol:;
  Gene Name: AC005477.1;
  ENSP ID: ENSP00000485077
MLISKIDVQVECYIISEEEASSPSLRGENGLVEEWSLNSVLKYVQDCFMWKAERKNIPGDEMFQQGHRAEESNSNRNWLAWT

SEQ ID NO: 973 - protein, 25 aa, Homo sapiens
  Payload ID: 180;
  Gene Symbol:;
  Gene Name: AC005480.1;
  ENSP ID: ENSP00000485283
MRAKWRKKRMCSLKHKRRKMRQRSK

SEQ ID NO: 974 - protein, 27 aa, Homo sapiens
  Payload ID: 181;
  Gene Symbol:;
  Gene Name: AC005779.2;
  ENSP ID: ENSP00000466282
IVAGCRLLPDIRGVPGTEPEKDPGPRA

SEQ ID NO: 975 - protein, 56 aa, Homo sapiens
  Payload ID: 182;
  Gene Symbol:;
  Gene Name: AC005943.2;
  ENSP ID: ENSP00000468614
MVTRFLGPRYRELVKNWVPTAYTWGAVGAVGLVWATDWRLILDWVPYINGKFKKDN

SEQ ID NO: 976 - protein, 124 aa, Homo sapiens
  Payload ID: 183;
  Gene Symbol:;
  Gene Name: AC006026.2;
  ENSP ID: ENSP00000485594
MTLNEHAAFKHLFNKAHLAPPLIHLTLSGHSTCFREHRVGDKVTDQQDPKAEEFFLVQNKMKSLPCPLLSTQTRQPSDFSIFSPPFPPFYSTKPPLSSWPIPNESLGTPPRRGRGRAEGLLTSQ

SEQ ID NO: 977 - protein, 132 aa, Homo sapiens
  Payload ID: 184;
  Gene Symbol:;
  Gene Name: AC006328.4;
  ENSP ID: ENSP00000485474
MGPTVLGQGEEGQPEAGACSGLLQPPKRPIVFKEKLTMKTDSLMEEKLECSLWCCLSDPSIPGRCCVLERRIVPWMQQESYSSSSPIRSVDSDEPNLTSVLERLEDTKDNSSSVRKETKLFSLFLINIIFRN

SEQ ID NO: 978 - protein, 25 aa, Homo sapiens
  Payload ID: 185;
  Gene Symbol:;
  Gene Name: AC006386.1;
  ENSP ID: ENSP00000485436
MRAKWRKKRTLRLKRQRRKMRQKSK

SEQ ID NO: 979 - protein, 40 aa, Homo sapiens
  Payload ID: 186;
  Gene Symbol:;
  Gene Name: AC006445.1;
  ENSP ID: ENSP00000485950
PAPAPAPPAPPAPGPAPGPGGGGGGGAGGGGCGCGLVAMV

SEQ ID NO: 980 - protein, 121 aa, Homo sapiens
  Payload ID: 187;
  Gene Symbol:;
  Gene Name: AC006449.1;
  ENSP ID: ENSP00000479002
MRDVGGKRRRGLHPFIPSLGPVFKSNLTATVVQSGECKRLGKVGEQPLGDENPSLWFGLREGRSVLGGVSWFQCTESLGPLTLQHGNLGVDLLLFPSRQKLSFALSGPALGKGVGVNEQLF

SEQ ID NO: 981 - protein, 121 aa, Homo sapiens; identical to SEQ ID NO: 980
  Payload ID: 188;
  Gene Symbol:;
  Gene Name: AC006449.2;
  ENSP ID: ENSP00000485082

SEQ ID NO: 982 - protein, 167 aa, Homo sapiens
  Payload ID: 189;
  Gene Symbol:;
  Gene Name: AC006486.9;
  ENSP ID: ENSP00000470087
MKTPADTGDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDP

SEQ ID NO: 983 - protein, 105 aa, Homo sapiens
  Payload ID: 190;
  Gene Symbol:;
  Gene Name: AC006538.4;
  ENSP ID: ENSP00000467958
MVKLLVAKILCMVGVFFFMLLGSLLPVKIIETDFEKAHRSKKILSLCNTFGGGVFLATCFNALLPAVREKARSGVLAAGTSPPGPGRPPAAGKMPEQSNDYRVVV

SEQ ID NO: 984 - protein, 107 aa, Homo sapiens [sequence omitted]

SEQ ID NO: 985 - protein, 197 aa, Homo sapiens
  Payload ID: 192;
  Gene Symbol:;
  Gene Name: AC007040.11;
  ENSP ID: ENSP00000475641
MWFMYLLSWLSLFIQVAFITLAVAAGLYYLAELIEEYTVATSRIIKYMIWFSTAVLIGLYVFERFPTSMIGVGLFTNLVYFGLLQTFPFIMLTSPNFILSCGLVVVNHYLAFQFFAEEYYPFSEVLAYFTFCLWIIPFAFFVSLSAGENVLPSTMQPGGLGLGRSTGHGDSCTDFYKDPPSVTTIWKTPGLEDSQRR

SEQ ID NO: 986 - protein, 49 aa, Homo sapiens
  Payload ID: 192;
  Gene Symbol:;
  Gene Name: AC007040.11;
  ENSP ID: ENSP00000475757
  MOD_RES (1)..(1): Any amino acid
XMYLLSWLSLFIQVAFITLAVAAGLYYLAELIEEYTVATSRIIKYMIWS

SEQ ID NO: 987 - protein, 124 aa, Homo sapiens
  Payload ID: 193;
  Gene Symbol:;
  Gene Name: AC007163.2;
  ENSP ID: ENSP00000485176
MTLNEHAAFKHLFNKAHLAPPLIHLTLSGHSTCFREHRVGDKVTDQQDPKAEEFFLVQNKMKSLPCLLLSTQTRQPCDFSIFSPPFPPFYSTKPPLSSWPIPNEPLGTPPRRGGGRAEGLLTSQ

SEQ ID NO: 988 - protein, 429 aa, Homo sapiens
  Payload ID: 194;
  Gene Symbol:;
  Gene Name: AC007325.1;
  ENSP ID: ENSP00000481613
MDSLWGPGAGSHPFGVHNTRLSPDLCPGKIVLRALKESGAGMPEQDKDPRVQENPGDQRRVPEVTGDAPSAFRPLRDNGGLSPFVPGPGPLQTDLHAQRSEIRYNQTSQTSWTSSCTNRNAISSSYSSTGGLPGLKRRRGPASSHCQLTLSSSKTVSEDRPQAVSSGHTQCEKAADIAPGQTLTLRNDSSTSEASRPSTHKFPLLPRRRGEPLMLPPPVELGYRVTVEDLDREKEAAFQRINSALQVEDKAISDCRPSRPSHTLSSLATGTSGLPAVSKAPSMDAQQETHKSQDCLGLLAPLASAAEVPSTAPVSGKKHRPPGPLFSSSDPLPATSSHSRDSAQVTSLIPAPFPAASMDAGMGRTRPGTSAPAAAAAAPPPSTLNPTLGSLLEWMEALHISGPQPQLQQVPRGQNQRSQTSRTSSCPKR

SEQ ID NO: 989 - protein, 600 aa, Homo sapiens
  Payload ID: 195;
  Gene Symbol:;
  Gene Name: AC007325.2;
  ENSP ID: ENSP00000481127
MALRRALPALRPCIPRFVPLSTAPASREQPAAGPAAVPGGGSATAVRPPVPAVDFGNAQEAYRSRRTWELARSLLVLRLCAWPALLARHEQLLYVSRKLLGQRLFNKLMKMTFYGHFVAGEDQESIQPLLRHYRAFGVSAILDYGVEEDLSPEEAEHKEMESCTSAAERDGSGTNKRDKQYQAHWAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASRAEIEDWFTAETLGVSGTMDLLDWSSLIDSRTKLSKHLVVPNAQTGQLEPLLSRFTEEEELQMTRMLQRMDVLAKKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHQVYFGQLLGMCDQISFPLGQAGYPVYKYVPYGPVMEVLPYLSRRALENSSLMKGTHRERQLLWLELLRRLRTGNLFHRPA

SEQ ID NO: 990 - protein, 492 aa, Homo sapiens
  Payload ID: 195;
  Gene Symbol:;
  Gene Name: AC007325.2;
  ENSP ID: ENSP00000482462
MKMTFYGHFVAGEDQESIQPLLRHYRAFGVSAILDYGVEEDLSPEEAEHKEMESCTSAAERDGSGTNKRDKQYQAHWAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASRAEIEDWFTAETLGVSGTMDLLDWSSLIDSRTKLSKHLVVPNAQTGQLEPLLSRFTEEEELQMTRMLQRMDVLAKKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHQVYFGQLLGMCDQISFPLGQAGYPVYKYVPYGPVMEVLPYLSRRALENSSLMKGTHRERQLLWLELLRRLRTGNLFHRPA

SEQ ID NO: 991 - protein, 220 aa, Homo sapiens
  Payload ID: 196;
  Gene Symbol:;
  Gene Name: AC007325.4;
  ENSP ID: ENSP00000482514
MERYAGALEEVADGARQQERHYQLLSALQSLVKELPSSFQQRLSYTTLSDLALALLDGTVFEIVQGLLEIQHLTEKSLYNQRLRLQNEHRVLRQALRQKHQEAQQACRPHNLPVLQAAQQRELEAVEHRIREEQRAMDQKIVLELDRKVADQQSTLEKAGVAGFYVTTNPQELMLQMNLLELIRKLQQRGCWAGKAALGLGGPWQLPAAQCDQKGSPVPP

SEQ ID NO: 992 - protein, 75 aa, Homo sapiens
  Payload ID: 197;
  Gene Symbol:;
  Gene Name: AC007326.1;
  ENSP ID: ENSP00000485226
MNPSEMQRKGPPRRWYLQVYPTAPKRQRPSRTGHDDDGGFVEKKRGKCGEKQERSDCYCVCVERSRHRRLHFVMC

SEQ ID NO: 993 - protein, 26 aa, Homo sapiens
  Payload ID: 198;
  Gene Symbol:;
  Gene Name: AC007557.5;
  ENSP ID: ENSP00000485284
SAKEKLRSQGIRRDKSRAASQGVRKG

SEQ ID NO: 994 - protein, 190 aa, Homo sapiens
  Payload ID: 199;
  Gene Symbol:;
  Gene Name: AC007906.1;
  ENSP ID: ENSP00000485088
MSLPIFVFSFNLEHVFVFLLSLSFGLDFILLPFFSSFPSTEAVGKFSGLITRGILRSPRSFAFAMASDIIRLAFSCLLSDSTFFLCFFSDMTLTWVFCNLVYVPEPSLFLEDGGLPLGLFTEDIFGVRQRLALCFFTTPGSAQEKSIERRFLNGLFSKLQPRDAQPSTNTHFDLSTHFCLGKFISTVHPI

SEQ ID NO: 995 - protein, 136 aa, Homo sapiens
  Payload ID: 200;
  Gene Symbol:;
  Gene Name: AC008074.1;
  ENSP ID: ENSP00000485379
MEAIFSAAESGFSGSLVGSNIPNPAAYMGTITGCFLLPVKRMFRVSIPKEDKSFLLLWEPPHWYLKPCASWISCSSVHTSSNSPLSGKASLVFIGKVLVSSKCFREVTSSSASGTSMEGKHASKIRSRRFKKLVNT

SEQ ID NO: 996 - protein, 173 aa, Homo sapiens
  Payload ID: 201;
  Gene Symbol:;
  Gene Name: AC008522.1;
  ENSP ID: ENSP00000485146
MALSVGSLQCVARPGLHQGGARQAVSQDGRHLALPVIDAFTQGAAVHAQLQVLALLVGHGQVFRHTDGKGQVATHLPHKHCGPYIAGVHLHIVATLPFHDTQALGIAVPTTGGAIHKGGRQVICHSLVDFLICTLMVGFEDNSDLWEGACTRFNRMGRKQNGVTLCSKSSPPF

SEQ ID NO: 997 - protein, 16 aa, Homo sapiens
  Payload ID: 202;
  Gene Symbol:;
  Gene Name: AC008622.1;
  ENSP ID: ENSP00000485124
ESRGGPVRIAGITGVC

SEQ ID NO: 998 - protein, 23 aa, Homo sapiens
  Payload ID: 203;
  Gene Symbol:;
  Gene Name: AC008641.1;
  ENSP ID: ENSP00000485568
MSRLVRGSSLLTYLVVALVLQSR

SEQ ID NO: 999 - protein, 128 aa, Homo sapiens
  Payload ID: 204;
  Gene Symbol:;
  Gene Name: AC008686.1;
  ENSP ID: ENSP00000485049
WLTPVIPALGEAEVGGLLESRSSRRSCAMIAPLHSSLGDRARPRLKKKKKKKKRKKRSLILRPCLTLSPRLTCNGTILAHCNLRLPGSSDSPASASQVAGITGTHHHTRLIFVFLVESPCWSAIVSSA

SEQ ID NO: 1000 - protein, 31 aa, Homo sapiens
  Payload ID: 205;
  Gene Symbol:;
  Gene Name: AC008759.1;
  ENSP ID: ENSP00000485338
KKILGRAQWLMPVIPALWEAEGLALSPRLEC

SEQ ID NO: 1001 - protein, 124 aa, Homo sapiens [sequence omitted]

SEQ ID NO: 1002 - protein, 24 aa, Homo sapiens
  Payload ID: 207;
  Gene Symbol:;
  Gene Name: AC008914.1;
  ENSP ID: ENSP00000485310
RCAWATRAKLHLKKKKKKTQKTNK

SEQ ID NO: 1003 - protein, 124 aa, Homo sapiens [sequence omitted]

SEQ ID NO: 1004 - protein, 126 aa, Homo sapiens
  Payload ID: 209;
  Gene Symbol:;
  Gene Name: AC009060.2;
  ENSP ID: ENSP00000485576
LVMTLNEHAAFKHLFNKAHLAPPLIHLTLSGHSTCFREHRVGGKVTDQQDPKAEEFFLVQNKMKSLPCLLLSTQTRQPSDFSIFSPPFPPFYSTKPPLSSWPVLNELLGTPPRRGGGQAGGLLTSQ

SEQ ID NO: 1005 - protein, 126 aa, Homo sapiens [sequence omitted]

SEQ ID NO: 1006 - protein, 178 aa, Homo sapiens
  Payload ID: 211;
  Gene Symbol:;
  Gene Name: AC009065.4;
  ENSP ID: ENSP00000485405
ELSSQKTGGNLDRHTASKPTALLQPGPGWQRGAACCLQILPESRVCFPTGLPLARKVTKLSWVGYKLQGRELQWPVYREELELERLLWRRRPGDRDLRRTGDLRLGERDLLLIRGGDLRHIGGGGNILLGGLNLLGGGLGQGASTAVAVISWPSICPPPSMCFSAFSASSGFSNSTYA

SEQ ID NO: 1007 - protein, 26 aa, Homo sapiens
  Payload ID: 212;
  Gene Symbol:;
  Gene Name: AC009121.2;
  ENSP ID: ENSP00000485751
SCSASTLSGGDLGSRTPAGPPENESA

SEQ ID NO: 1008 - protein, 164 aa, Homo sapiens
  Payload ID: 213;
  Gene Symbol:;
  Gene Name: AC009133.22;
  ENSP ID: ENSP00000404873
MDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDL

SEQ ID NO: 1009 - protein, 359 aa, Homo sapiens
  Payload ID: 214;
  Gene Symbol:;
  Gene Name: AC009133.23;
  ENSP ID: ENSP00000476774
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMPAAGGRGRGPASGPGSQALKHRGAGGGSPHHHRLLRHQLRRVPALVAYVPCSGPWRHCGQYGGASV

SEQ ID NO: 1010 - protein, 123 aa, Homo sapiens
  Payload ID: 215;
  Gene Symbol:;
  Gene Name: AC009286.1;
  ENSP ID: ENSP00000487241
MAWTPLLLLLLSHCTGSLSQPVLTQPTSLSASPGASARFTCTLRSGINVGTYRIYWYQQKPGSLPRYLLRYKSDSDKQQGSGVPSRFSGSKDASTNAGLLLISGLQSEDEADYYCAIWYSSTS

SEQ ID NO: 1011 - protein, 146 aa, Homo sapiens
  Payload ID: 216;
  Gene Symbol:;
  Gene Name: AC009336.19;
  ENSP ID: ENSP00000424734
MVMSSYMVNSKYVDPKFPPCEEYLQGGYLGEQGADYYGGGAQGADFQPPGLYPRPDFGEQPFGGSGPGPGSALPARGHGQEPGGPGGHYAAPGEPCPAPPAPPPAPLPGARAYSQSDPKQPPSGTALKQPAVVYPWMKKVHVNSGI

SEQ ID NO: 1012 - protein, 128 aa, Homo sapiens
  Payload ID: 217;
  Gene Symbol:;
  Gene Name: AC009491.1;
  ENSP ID: ENSP00000485137
MHLHRHLLCQATGTCGNGDIHAVSVVCSHRRRCLDSEEVTEICSSDFIPGRDCVGESGPMIGMLSRSQGLLGKGRQHDKGKSKVEQSSYTLNWPPMGAGEGAGPHPPLTSLYPHLYLMIWLLKLSVLK

SEQ ID NO: 1013 - protein, 128 aa, Homo sapiens
  Payload ID: 218;
  Gene Symbol:;
  Gene Name: AC009491.2;
  ENSP ID: ENSP00000485446
MHLLGGLLLQQSAETWPLLAVSVVGSHWRRRCFDCEVITRNCSSDSIPERGSVQEIGPMGIGILSVSQGLSQIGRKHDKGKSKLEKYSHTSNWPLTHAGEGVGPHPPLTRLHLQPYLTFLLLILSVPE

SEQ ID NO: 1014 - protein, 314 aa, Homo sapiens
  Payload ID: 219;
  Gene Symbol:;
  Gene Name: AC009758.1;
  ENSP ID: ENSP00000485078
MPTVNHSGTSHTVFHLLGIPGLQDQHMWISIPFFISYVTALLGNSLLIFIILTKRSLHEPMYLFLCMLAGADIVLSTCTIPQALAIFWFRAGDISLDRCITQLFFIHSTFISESGILLVMAFDHYIAICYPLRYTTILTNALIKKICVTVSLRSYGTIFPIIFLLKRLTFCQNNIIPHTFCEHIGLAKYACNDIRINIWYGFSILMSTVVLDVVLIFISYMLILHAVFHMPSPDACHKALNTFGSHVCIIILFYGSGIFTILTQRFGRHIPPCIHIPLANVCILAPPMLNPIIYGIKTKQIQEQVVQFLFIKQK

SEQ ID NO: 1015 - protein, 555 aa, Homo sapiens
  Payload ID: 220;
  Gene Symbol:;
  Gene Name: AC009950.1;
  ENSP ID: ENSP00000439558
MGRGFRMFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPGGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKSGLLLCPPRINLKRELNSK

SEQ ID NO: 1016 - protein, 33 aa, Homo sapiens
  Payload ID: 221;
  Gene Symbol:;
  Gene Name: AC009977.1;
  ENSP ID: ENSP00000485119
KHKKKVIERWSLALLPRLECSGAILAHCKLRLP

SEQ ID NO: 1017 - protein, 23 aa, Homo sapiens
  Payload ID: 222;
  Gene Symbol:;
  Gene Name: AC010184.1;
  ENSP ID: ENSP00000485684
RAAAPAHAAPSRSCPAGSATLEP

SEQ ID NO: 1018 - protein, 120 aa, Homo sapiens
  Payload ID: 223;
  Gene Symbol:;
  Gene Name: AC010287.1;
  ENSP ID: ENSP00000485180
MPIIPSLWEAGRSLEARSSKIFCILIVVVVTQLYKFVKIQRTIHLKGRLLLYEVYLINNQPKNLCSHFSFPTTYIKKERLWLGPVAHTYNPSTLGGRGGWITRGQEFKTSLANMVEPCLY

SEQ ID NO: 1019 - protein, 124 aa, Homo sapiens
  Payload ID: 224;
  Gene Symbol:;
  Gene Name: AC010412.1;
  ENSP ID: ENSP00000485147
MTLNEHAAFKHLFNKAHLAPPLIHSTLSGHSTCFREHRVGGKVTDQQDPKAEEFFLVQNKMKSLPCLPLPTQTQQPSDFSIFSPPFPIFYSTKLPLSSWPVLNELLSTPPRRGGGRAEGLLTSQ

SEQ ID NO: 1020 - protein, 94 aa, Homo sapiens
  Payload ID: 225;
  Gene Symbol:;
  Gene Name: AC010547.9;
  ENSP ID: ENSP00000463741
MAAMPLKAQYQEMVTFEDVAVHFTKTEWTGLSPAQRALYRSVMLENFGNLTALGYPVPKPALISLLERGDMAWGLEAQDDPPAERTKNVCKVIL

SEQ ID NO: 1021 - protein, 137 aa, Homo sapiens [sequence omitted]

SEQ ID NO: 1022 - protein, 46 aa, Homo sapiens
  Payload ID: 227;
  Gene Symbol:;
  Gene Name: AC010646.3;
  ENSP ID: ENSP00000473056
MRKEAVQRGRIPHSLPGAVAASSGSPPGSALAAVASGGDLFPGQPV

SEQ ID NO: 1023 - protein, 22 aa, Homo sapiens
  Payload ID: 228;
  Gene Symbol:;
  Gene Name: AC010655.1;
  ENSP ID: ENSP00000485293
SHLFNNYLLNVKMTLGSVFASV

SEQ ID NO: 1024 - protein, 120 aa, Homo sapiens
  Payload ID: 229;
  Gene Symbol:;
  Gene Name: AC011043.2;
  ENSP ID: ENSP00000482855
MYSFPTTVVEERLSLSIHLVTFPTVSREILLEITSQTNKKQSWEMYDTHSAKEIGIIAGEQIQKTQAVPYICFLLRHQLISQSSQVRVEAMYSLLFLGTLLQGGKGQEVLLEDALRARAP

SEQ ID NO: 1025 - protein, 42 aa, Homo sapiens
  Payload ID: 230;
  Gene Symbol:;
  Gene Name: AC011155.1;
  ENSP ID: ENSP00000485198
GKDAKEKKQLTYNSSSYISWTVGMYHVFHLHCTCLRHRISLR

SEQ ID NO: 1026 - protein, 131 aa, Homo sapiens
  Payload ID: 231;
  Gene Symbol:;
  Gene Name: AC011295.1;
  ENSP ID: ENSP00000478066
MGPAVLGQGEEGQPEARACSGLLQPPKRPIVFKEKLTMKTDSLMEEKLECSLWCCLSDPSTPGRCCVLERRIVPWMQQESYSSSSPIWSVDSDEPNLTSVLERLEDTKDNSSVRKETKLFSLFLMNIIFRN

SEQ ID NO: 1027 - protein, 16 aa, Homo sapiens
  Payload ID: 232;
  Gene Symbol:;
  Gene Name: AC011380.1;
  ENSP ID: ENSP00000487555
NSQSGTREAETGRRKK

SEQ ID NO: 1028 - protein, 152 aa, Homo sapiens
  Payload ID: 233;
  Gene Symbol:;
  Gene Name: AC011513.3;
  ENSP ID: ENSP00000469421
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSN

SEQ ID NO: 1029 - protein, 67 aa, Homo sapiens
  Payload ID: 233;
  Gene Symbol:;
  Gene Name: AC011513.3;
  ENSP ID: ENSP00000469926
MESPSAPPHRWCIPWQRLLLTASLLTFWNPPTTAKLTIESTPFNVAEGKEVLLLAHNLPQNRIGYSW

SEQ ID NO: 1030 - protein, 132 aa, Homo sapiens
  Payload ID: 234;
  Gene Symbol:;
  Gene Name: AC011530.4;
  ENSP ID: ENSP00000468837
PLVCKKIAQERLTVLLFLEDCIITACQEGLICTWARPGKAFTDEETEAQTGEGSWPRSPSKSVVEELGASELAQDKYVADFLQWAEPIVVRLKEVRLQRDDFEILKVIGRGAFSEVAVVKMKQTGQVYAMKI

SEQ ID NO: 1031 - protein, 107 aa, Homo sapiens
  Payload ID: 234;
  Gene Symbol:;
  Gene Name: AC011530.4;
  ENSP ID: ENSP00000469741
PLVCKKIAQERLTVLLFLEDCIITACQEGLICTWARPGKAELGASELAQDKYVADFLQWAEPIVVRLKEVRLQRDDFEILKVIGRGAFSEVAVVKMKQTGQVYAMKI

SEQ ID NO: 1032 - protein, 132 aa, Homo sapiens
  Payload ID: 234;
  Gene Symbol:;
  Gene Name: AC011530.4;
  ENSP ID: ENSP00000471312
  MOD_RES (1)..(1): Any amino acid
XGVAAEPGTPFSIGRFATLTLQERRDRGAEKEHKRYHSLGNISRGGSGGSGSGGEKPSGPVPRSRLDPAKVLGTALCPRIHEVPLLEPLVCKKIAQERLTVLLFLEDCIITACQEGLICTWARPGKARSPSW

SEQ ID NO: 1033 - protein, 56 aa, Homo sapiens
  Payload ID: 234;
  Gene Symbol:;
  Gene Name: AC011530.4;
  ENSP ID: ENSP00000472333
PLVCKKIAQERLTVLLFLEDCIITACQEGLICTWARPGKAPQIQGFPKCGSRTTCI

SEQ ID NO: 1034 - protein, 120 aa, Homo sapiens; identical to SEQ ID NO: 1024
  Payload ID: 235;
  Gene Symbol:;
  Gene Name: AC011841.1;
  ENSP ID: ENSP00000481644

SEQ ID NO: 1035 - protein, 25 aa, Homo sapiens
  Payload ID: 236;
  Gene Symbol:;
  Gene Name: AC012005.3;
  ENSP ID: ENSP00000485052
MRAKWRKKRTLRLKRQRRKMRQKSK

SEQ ID NO: 1036 - protein, 132 aa, Homo sapiens; identical to SEQ ID NO: 977
  Payload ID: 237;
  Gene Symbol:;
  Gene Name: AC012005.4;
  ENSP ID: ENSP00000485564

SEQ ID NO: 1037 - protein, 194 aa, Homo sapiens [sequence omitted]

SEQ ID NO: 1038 - protein, 139 aa, Homo sapiens
  Payload ID: 238;
  Gene Symbol:;
  Gene Name: AC012314.2;
  ENSP ID: ENSP00000486181
MPVARSWVCRKTYVTPRRPFEKSRLDQELKLIGEYGLRNKREVWRVKFTLAKIRKAARELLTLDEKDPRRLFEGNALLRRLVRIGVLDEGKMKLDYILGLKIEDFLERRLQTQVFKLGLAKSIHHARVLIRQRHISPRR

SEQ ID NO: 1039 - protein, 194 aa, Homo sapiens [sequence omitted]

SEQ ID NO: 1040 - protein, 139 aa, Homo sapiens; identical to SEQ ID NO: 1038
  Payload ID: 239;
  Gene Symbol:;
  Gene Name: AC012314.3;
  ENSP ID: ENSP00000486047

SEQ ID NO: 1041 - protein, 194 aa, Homo sapiens [sequence omitted]

SEQ ID NO: 1042 - protein, 139 aa, Homo sapiens; identical to SEQ ID NO: 1038
  Payload ID: 240;
  Gene Symbol:;
  Gene Name: AC012314.5;
  ENSP ID: ENSP00000485843

SEQ ID NO: 1043 - protein, 194 aa, Homo sapiens [sequence omitted]

SEQ ID NO: 1044 - protein, 139 aa, Homo sapiens; identical to SEQ ID NO: 1038
  Payload ID: 241;
  Gene Symbol:;
  Gene Name: AC012314.6;
  ENSP ID: ENSP00000486598

SEQ ID NO: 1045 - protein, 194 aa, Homo sapiens [sequence omitted]

SEQ ID NO: 1046 - protein, 139 aa, Homo sapiens; identical to SEQ ID NO: 1038
  Payload ID: 242;
  Gene Symbol:;
  Gene Name: AC012314.7;
  ENSP ID: ENSP00000486773

SEQ ID NO: 1047 - protein, 194 aa, Homo sapiens [sequence omitted]

SEQ ID NO: 1048 - protein, 139 aa, Homo sapiens; identical to SEQ ID NO: 1038
  Payload ID: 243;
  Gene Symbol:;
  Gene Name: AC012314.9;
  ENSP ID: ENSP00000486233

SEQ ID NO: 1049 - protein, 14 aa, Homo sapiens
  Payload ID: 244;
  Gene Symbol:;
  Gene Name: AC012363.2;
  ENSP ID: ENSP00000486995
LSGNESKGHSSLSL

SEQ ID NO: 1050 - protein, 149 aa, Homo sapiens
  Payload ID: 245;
  Gene Symbol:;
  Gene Name: AC013269.5;
  ENSP ID: ENSP00000386773
MTVNKIMVHADYNELHRMGSDITLLQLHHHVEFSSHILPACLPEPTTWLAPDSSCWISGWGMVTEDVFLPEPFQLQEAEVGVMDNTVCGSFFQPQYPGQPSSSDYTIHEDMLCAGDLITGKAICRCGELRPREEVYHPSETPGVPSSAH

SEQ ID NO: 1051 - protein, 16 aa, Homo sapiens
  Payload ID: 246;
  Gene Symbol:;
  Gene Name: AC013286.1;
  ENSP ID: ENSP00000487141
MAVSESIASTPQNHYT

SEQ ID NO: 1052 - protein, 93 aa, Homo sapiens
  Payload ID: 247;
  Gene Symbol:;
  Gene Name: AC015688.3;
  ENSP ID: ENSP00000463557
SWSPVIQRCSQPYGFSLLISFFLKCVSETSQQPPRQKNTACPALQTRSTRPRFRLLAINPTREMELHLLFLKMTPPTTKPVMTDSKCLHVYFS

SEQ ID NO: 1053 - protein, 66 aa, Homo sapiens
  Payload ID: 247;
  Gene Symbol:;
  Gene Name: AC015688.3;
  ENSP ID: ENSP00000464452
  MOD_RES (1)..(1): Any amino acid
XTSQQPPRQKNTACPALQTRSTRPRFRLLAINPTREMELHLLFLKMTPPTTKPVMTDSKCLHVYFS

SEQ ID NO: 1054 - protein, 124 aa, Homo sapiens [sequence omitted]

SEQ ID NO: 1055 - protein, 121 aa, Homo sapiens
  Payload ID: 249;
  Gene Symbol:;
  Gene Name: AC016549.1;
  ENSP ID: ENSP00000486279
MGALIISGSSAGPVTKQASLPPWGLSHGRCGFLLYMEMTLCSHRTQSFSELSQSLMRPGFLQMPYISCAKLSKIWFPASKPCLLAFLEVFLLMSRLSLFSKMICFLFLSFLFPPHIYTHAS

SEQ ID NO: 1056 - protein, 75 aa, Homo sapiens
  Payload ID: 250;
  Gene Symbol:;
  Gene Name: AC016577.1;
  ENSP ID: ENSP00000485075
MNPSEMQRKGPPRRWYLQVYPTAPKRQRPSRTGHDDDGGFVEKKRGKCGEKQERSNCYCVCVERSRHRRLHFVMC

SEQ ID NO: 1057 - protein, 268 aa, Homo sapiens
  Payload ID: 251;
  Gene Symbol:;
  Gene Name: AC016734.1;
  ENSP ID: ENSP00000480313
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 1058 - protein, 182 aa, Homo sapiens
  Payload ID: 251;
  Gene Symbol:;
  Gene Name: AC016734.1;
  ENSP ID: ENSP00000483086
MHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 1059 - protein, 106 aa, Homo sapiens
  Payload ID: 251;
  Gene Symbol:;
  Gene Name: AC016734.1;
  ENSP ID: ENSP00000485058
  MOD_RES (1)..(1): Any amino acid
XDGTEIHEASAILVHLSRGGAEVQIFAPDVPQMHVIDHTKGQPSEGESRNVLTESARIARGKITDLANLSAANHDAAIFPGGFGAAKNLGSPYSDPAKHRSLGLQL

SEQ ID NO: 1060 - protein, 237 aa, Homo sapiens
  Payload ID: 251;
  Gene Symbol:;
  Gene Name: AC016734.1;
  ENSP ID: ENSP00000485300
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 1061 - protein, 224 aa, Homo sapiens
  Payload ID: 251;
  Gene Symbol:;
  Gene Name: AC016734.1;
  ENSP ID: ENSP00000485335
PSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGHSLKDLPGHCPGRPLKWSLRKRCRLRAPEGGPCCSRVTAGVKVSPMVSTSGSRPCQRSVPWMSAQREEPMALSSVTD

SEQ ID NO: 1062 - protein, 57 aa, Homo sapiens
  Payload ID: 251;
  Gene Symbol:;
  Gene Name: AC016734.1;
  ENSP ID: ENSP00000485404
MAAVRALVASRLAAASAFTSLSPGGRTPSQRAALHLSVPRPAARVALDPGAPEPWRG

SEQ ID NO: 1063 - protein, 137 aa, Homo sapiens
  Payload ID: 251;
  Gene Symbol:;
  Gene Name: AC016734.1;
  ENSP ID: ENSP00000485439
  MOD_RES (1)..(1): Any amino acid
XDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGGSPYSDPAKHRSLGLQL

SEQ ID NO: 1064 - protein, 25 aa, Homo sapiens
  Payload ID: 252;
  Gene Symbol:;
  Gene Name: AC016753.2;
  ENSP ID: ENSP00000486211
IIIIIIIIKFIFIYLFIFFETGSHC

SEQ ID NO: 1065 - protein, 88 aa, Homo sapiens
  Payload ID: 253;
  Gene Symbol:;
  Gene Name: AC017028.10;
  ENSP ID: ENSP00000485328
MRSQGQGGPGAWRRMESWSAEPAGPGQGRLGSPCEAAEQASFEKTVIGVGQARAALSEEEHRVWEAAAGVGGLEQWGCWEAGVTSGWG

SEQ ID NO: 1066 - protein, 126 aa, Homo sapiens
  Payload ID: 254;
  Gene Symbol:;
  Gene Name: AC017081.1;
  ENSP ID: ENSP00000485556
MVMTLNEHAAFKHLFNKAHLAPPLIHLTLSGHSTCFREHRVGGKVIDQQDPKAEEFFLVQNKMKSLPCLLLSTQTRQPSDFSIFSPPFPLFYSTKPPLSSWPVLNELLGTPPRRGGGRAEGLLTSQ

SEQ ID NO: 1067 - protein, 16 aa, Homo sapiens
  Payload ID: 255;
  Gene Symbol:;
  Gene Name: AC018512.1;
  ENSP ID: ENSP00000485162
MSQKKKKKSQKKEKKK

SEQ ID NO: 1068 - protein, 551 aa, Homo sapiens
  Payload ID: 256;
  Gene Symbol:;
  Gene Name: AC018755.18;
  ENSP ID: ENSP00000415200
MLPLLLLPLLWGGSLQEKPVYELQVQKSVTVQEGLCVLVPCSFSYPWRSWYSSPPLYVYWFRDGEIPYYAEVVATNNPDRRVKPETQGRFRLLGDVQKKNCSLSIGDARMEDTGSYFFRVERGRDVKYSYQQNKLNLEVTALIEKPDIHFLEPLESGRPTRLSCSLPGSCEAGPPLTFSWTGNALSPLDPETTRSSELTLTPRPEDHGTNLTCQMKRQGAQVTTERTVQLNVSYAPQTITIFRNGIALEILQNTSYLPVLEGQALRLLCDAPSNPPAHLSWFQGSPALNATPISNTGILELRRVRSAEEGGFTCRAQHPLGFLQIFLNLSVYSLPQLLGPSCSWEAEGLHCRCSFRARPAPSLCWRLEEKPLEGNSSQGSFKVNSSSAGPWANSSLILHGGLSSDLKVSCKAWNIYGSQSGSVLLLQGRSNLGTGVVPAALGGAGVMALLCICLCLIFFLIVKARRKQAAGRPEKMDDEDPIMGTITSGSRKKPWPDSPGDQASPPGDAPPLEEQKELHYASLSFSEMKSREPKDQEAPSTTEYSEIKTSK

SEQ ID NO: 1069 - protein, 551 aa, Homo sapiens; identical to SEQ ID NO: 1068
  Payload ID: 256;
  Gene Symbol:;
  Gene Name: AC018755.18;
  ENSP ID: ENSP00000470259

SEQ ID NO: 1070 - protein, 24 aa, Homo sapiens
  Payload ID: 257;
  Gene Symbol:;
  Gene Name: AC018867.1;
  ENSP ID: ENSP00000487424
IPPALASQAAGSTDSVSKKKKKII

SEQ ID NO: 1071 - protein, 15 aa, Homo sapiens
  Payload ID: 258;
  Gene Symbol:;
  Gene Name: AC018902.1;
  ENSP ID: ENSP00000486897
MVILKIYTEFSRVWI

SEQ ID NO: 1072 - protein, 64 aa, Homo sapiens
  Payload ID: 259;
  Gene Symbol:;
  Gene Name: AC019206.1;
  ENSP ID: ENSP00000485336
SRRRSKSSRRSSRRSSRRSRSKRSRSRRRSKSSRRSSRRSRRRSRTRRSRSSSRRSSTNRSSSK

SEQ ID NO: 1073 - protein, 51 aa, Homo sapiens
  Payload ID: 260;
  Gene Symbol:;
  Gene Name: AC021106.1;
  ENSP ID: ENSP00000485267
MKMELGRDVCSSALRIMKATNIKKRSGGRDTVAPQGMNQLGKEKKESLLSS

SEQ ID NO: 1074 - protein, 167 aa, Homo sapiens
  Payload ID: 261;
  Gene Symbol:;
  Gene Name: AC022016.1;
  ENSP ID: ENSP00000489443
MGKDFMTKTPKAMATKAKIDKWDLIKLKSFCTAKETTIRVNRQPTEWEKIFTIYPSDKGQSHYWVYTQRIINHATIKTHAHVCLLSIIKKQKQKQKQTSLPVVLALWEAKVGGLLELRRLRPAWAKWKNHVSTKNTKISWAWWCVPIVPATWEAEVGRSPEPQEVKV

SEQ ID NO: 1075 - protein, 18 aa, Homo sapiens
  Payload ID: 262;
  Gene Symbol:;
  Gene Name: AC022210.1;
  ENSP ID: ENSP00000485425
MTLPRKQTLSHEARKPLS

SEQ ID NO: 1076 - protein, 124 aa, Homo sapiens; identical to SEQ ID NO: 1019
  Payload ID: 263;
  Gene Symbol:;
  Gene Name: AC022405.1;
  ENSP ID: ENSP00000485588

SEQ ID NO: 1077 - protein, 27 aa, Homo sapiens
  Payload ID: 264;
  Gene Symbol:;
  Gene Name: AC022819.2;
  ENSP ID: ENSP00000485910
VTRLCTRISFSILPKNKNLFFNFTTLH

SEQ ID NO: 1078 - protein, 429 aa, Homo sapiens
  Payload ID: 265;
  Gene Symbol:;
  Gene Name: AC023491.2;
  ENSP ID: ENSP00000484693
MDSLWGPGAGSHPFGVHNTRLSPDLCPGKIVLRALKESGAGMPEQDKDPRVQENPGDQRRVPEVTGDAPSAFRPLRDNRGLSPFVPGPGPLQTDLHAQRSEIRYNQTSQISWTSSCTNRNAISSSYSSMGGLPGLKRRRGPASSHCQLTLSSSKTVSEDRPQAVSSGHTQCEKAADIAPGQTLALRNDSSTSEASRPSTHKFPLLPRRRGEPLMLPPPLELGYRVTVEDLDREKEAAFQRINSALQVEDKAISDCRPSRPSHTLSSLATGTSGLPAISKAPSMDVQQETHKSQDCLGLLAPLASAAGVPSTAPMSGKKHRPPGPLFSSSDPLPATSSHSQDSAQVTSLIPAPFPAASMDAGMRRTRCGTSAPAAAAAAPPPSTLNPTLGSLLEWMEALHISGPQPQLQQVPRGQNQRSQTSRTSSCPKR

SEQ ID NO: 1079 - protein, 21 aa, Homo sapiens
  Payload ID: 266;
  Gene Symbol:;
  Gene Name: AC024060.1;
  ENSP ID: ENSP00000486286
LKRLVDGVSLCRPGWSAVARS

SEQ ID NO: 1080 - protein, 18 aa, Homo sapiens [sequence omitted]

SEQ ID NO: 1081 - protein, 121 aa, Homo sapiens
  Payload ID: 268;
  Gene Symbol:;
  Gene Name: AC024592.12;
  ENSP ID: ENSP00000465499
MAPKVFRQYWDIPDGTDCHRKAYSTTSIASVAGLTAAAYRVTLNPPGTFLEGVAKVGQYTFTAAAVGAVFGLTTCISAHVREKPDDPLNYFLGGCAGGLTLGARKTGFHRVSQDGLDLLTS

SEQ ID NO: 1082 - protein, 169 aa, Homo sapiens
  Payload ID: 268;
  Gene Symbol:;
  Gene Name: AC024592.12;
  ENSP ID: ENSP00000466639
  MOD_RES (1)..(1): Any amino acid
XPKVFRQYWDIPDGTDCHRKAYSTTSIASVAGLTAAAYRVTLNPPGTFLEGVAKVGQYTFTADTGSERPRGSCCARLEALALPVYPAAAVGAVFGLTTCISAHVREKPDDPLNYFLGGCAGGLTLGARTTLTHGSPGPSQATVAVAPLSGRAAVSAAGGCVFLLLPACV

SEQ ID NO: 1083 - protein, 144 aa, Homo sapiens
  Payload ID: 268;
  Gene Symbol:;
  Gene Name: AC024592.12;
  ENSP ID: ENSP00000467210
  MOD_RES (1)..(1): Any amino acid
XPKVFRQYWDIPDGTDCHRKAYSTTSIASVAGLTAAAYRVTLNPPGTFLEGVAKVGQYTFTAAAVGAVFGLTTCISAHVREKPDDPLNYFLGGCAGGLTLGARTTLTHGSPGPSQATVAVAPLSGRAAVSAAGGCVFLLLPACV

SEQ ID NO: 1084 - protein, 76 aa, Homo sapiens
  Payload ID: 269;
  Gene Symbol:;
  Gene Name: AC025263.3;
  ENSP ID: ENSP00000454833
LQPIRFVKASAVECGGPKKCALTGQSKSCKHRIKLGDSSNYYYISPFCRYRITSVCNFFTYIRYIQQGLVKQQDVL

SEQ ID NO: 1085 - protein, 124 aa, Homo sapiens [sequence omitted]

SEQ ID NO: 1086 - protein, 185 aa, Homo sapiens
  Payload ID: 271;
  Gene Symbol:;
  Gene Name: AC026369.1;
  ENSP ID: ENSP00000480683
MESLLENPVRAVLYLKELTAIVQNQQSLIHTQRERIDELERRLDELSAENRSLWEHQQLLQAQPPPGLVPPSSAPLPAAPATAPAAAARAQEPLQDQGQRSAAAPHPAPDRPPRQHHGQLLEQPQRGPGSRAHTPQSPHKHLGTQGAVTDKEKERPPSCCAAAGALLQHKSPSALGKGVLSRRPE

SEQ ID NO: 1087 - protein, 21 aa, Homo sapiens
  Payload ID: 272;
  Gene Symbol:;
  Gene Name: AC026449.1;
  ENSP ID: ENSP00000485486
KVYFCFSLLHNFLRKRSWESF

SEQ ID NO: 1088 - protein, 291 aa, Homo sapiens
  Payload ID: 273;
  Gene Symbol:;
  Gene Name: AC037459.4;
  ENSP ID: ENSP00000399696
MDSEGGSLLLDEDSEVFKMLQENREGRAAPRQSSSFRLLQEALEAEERDGAGEGLARGCIVPGVTSTYRRIPDAAHGCSSWERGDKFRGVGREALFLKLASRDSGVEMAVGDSPLAALPGLSQDSLDFESSGSSEPPAQVGRLLASQKLGEVLERSRRLPTAPTSLSGQHRSLRLASKPEREVPLGAGQQESMEADTDLEAGLEEEAVGGLGPGAWACLPGQGLRYLEHLCLVLEQMARLQQLYLQLRIQRPPGDPGEEESTRAPLPSPLHTPGNRGQGPWELLSQTEHTG

SEQ ID NO: 1089 - protein, 132 aa, Homo sapiens
  Payload ID: 273;
  Gene Symbol:;
  Gene Name: AC037459.4;
  ENSP ID: ENSP00000428700
MDSEGGSLLLDEDSEVFKMLQENREGRAAPRQSSSFRLLQEALEAEERGGTPAFLPSSLSPQSSLPASRALATPPKLHTCEKCSTSIANQAVRIQEGRYRHPGCYTCADCGLNLKMRGHFWMGLARAWHGAA

SEQ ID NO: 1090 - protein, 141 aa, Homo sapiens
  Payload ID: 273;
  Gene Symbol:;
  Gene Name: AC037459.4;
  ENSP ID: ENSP00000429988
  MOD_RES (1)..(1): Any amino acid
XAVLVLPPSPGPRSSRPSMDSEGGSLLLDEDSEVFKMLQENREGRAAPRQSSSFRLLQEALEAEERGGTPAFLPSSLSPQSSLPASRALATPPKLHTCEKCSTSIAWGWRGPGTGLHSAWSHQHLQTDPRRCPRVLILGER

SEQ ID NO: 1091 - protein, 210 aa, Homo sapiens
  Payload ID: 274;
  Gene Symbol:;
  Gene Name: AC037482.2;
  ENSP ID: ENSP00000459798
MVSSCCGSVCSDQGCGQVLCQETCCRPSCCQTTCCRTTCYRPSCCVSSCCRPQCCQSVCCQPTCCRPSCCETTCCHPRCCISSCCRPSCCMSSCCKPQCCQSVCCQPTCCHPSCCISSCCRPSCCVSRCCRPQCCQSVCCQPTCCRPSCCISSCCRPSCCESSCCRPCCCRPCCCLRPVCGRVSCHTTCYRPTCVISTCPRPLCCASSCC

SEQ ID NO: 1092 - protein, 124 aa, Homo sapiens
  Payload ID: 275;
  Gene Symbol:;
  Gene Name: AC055733.1;
  ENSP ID: ENSP00000485356
MTLNEHAAFKHLFNKAHLAPPLIHLTLSGHSTCFREHRVGDKVTDQQDPKAEEFFLVQNKMKSLPCLLLSIQTRQPCDFSIFSPPFPPFYSTKPPLSSWPIPNEPLGTPPRRGGGRAEGLLTSQ

SEQ ID NO: 1093 - protein, 11 aa, Homo sapiens
  Payload ID: 276;
  Gene Symbol:;
  Gene Name: AC055866.1;
  ENSP ID: ENSP00000486664
GDFLPPGQVVL

SEQ ID NO: 1094 - protein, 17 aa, Homo sapiens
  Payload ID: 277;
  Gene Symbol:;
  Gene Name: AC063956.1;
  ENSP ID: ENSP00000485465
IKFRLFAISLILMLSVT

SEQ ID NO: 1095 - protein, 17 aa, Homo sapiens
  Payload ID: 278;
  Gene Symbol:;
  Gene Name: AC063956.2;
  ENSP ID: ENSP00000488950
IKFRLFAISLILMLSVT

SEQ ID NO: 1096 - protein, 95 aa, Homo sapiens
  Payload ID: 279;
  Gene Symbol:;
  Gene Name: AC064829.1;
  ENSP ID: ENSP00000485106
THLHRGLFLCQAAGNCRIQDISVVRSHWRKRFLNSEVVAENCFSDFIPERGCVQESGPMEIGLLSGKVEGPHPPLTRLYPLPYLILFLLTLCVPK

SEQ ID NO: 1097 - protein, 128 aa, Homo sapiens [sequence omitted]

SEQ ID NO: 1098 - protein, 124 aa, Homo sapiens
  Payload ID: 280;
  Gene Symbol:;
  Gene Name: AC066615.1;
  ENSP ID: ENSP00000453665
MTLNEHAAFKHLFNKAHLAPPLIHLTLSGHSTCFREHRVGDKVTDQQDPKAEEFFLVQNKMKSLPCLLLSTQTRQPSDFSIFSPPFPPFYSTKPPLSSWPIPNEPLGTPPRRGCGRAEGLLTSQ

SEQ ID NO: 1099 - protein, 307 aa, Homo sapiens
  Payload ID: 281;
  Gene Symbol:;
  Gene Name: AC068533.7;
  ENSP ID: ENSP00000396527
MDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTIRKDANSALLSNYEVFQLLTDLKEQRKESGKNKHSSGQQNLNTITYETLKYISKTPCRHQSPEIVREFLTALKSHKLTKAEKLQLLNHRPVTAVEIQLMVEESEERLTEEQIEALLHTVTS

SEQ ID NO: 1100 - protein, 22 aa, Homo sapiens
  Payload ID: 282;
  Gene Symbol:;
  Gene Name: AC069063.1;
  ENSP ID: ENSP00000485481
MTHIYSNFCFNKSVFAFDLIPM

SEQ ID NO: 1101 - protein, 36 aa, Homo sapiens
  Payload ID: 283;
  Gene Symbol:;
  Gene Name: AC069063.2;
  ENSP ID: ENSP00000485237
MIPLYPSFNFNKSHFAFQILPIATNILFFSGVAELI

SEQ ID NO: 1102 - protein, 227 aa, Homo sapiens
  Payload ID: 284;
  Gene Symbol:;
  Gene Name: AC069368.3;
  ENSP ID: ENSP00000397942
MEEEGVKEAGEKPRGAQMVDKAGWIKKSSGGLLGFWKDRYLLLCQAQLLVYENEDDQKCVETVELGSYEKCQDLRALLKRKHRFILLRSPGNKVSDIKFQAPTGEEKESWIKALNEGINRGKNKAFDEVKVDKSCALEHVTRDRVRGGQRRRPPTRVHLKEFGMNALLLSAWFGHLRILQILVNSGAKIHCESKEGNTALHLAAGRGHMAVLQRLVDIGLDLEEQNA

SEQ ID NO: 1103 - protein, 16 aa, Homo sapiens
  Payload ID: 285;
  Gene Symbol:;
  Gene Name: AC069499.1;
  ENSP ID: ENSP00000486986
AKSSCLKALLIRVSHY

SEQ ID NO: 1104 - protein, 41 aa, Homo sapiens
  Payload ID: 286;
  Gene Symbol:;
  Gene Name: AC073072.1;
  ENSP ID: ENSP00000486755
WLMPVISALWEAKVGGSPEICSFSGVQDQPGQHGETQSLQK

SEQ ID NO: 1105 - protein, 16 aa, Homo sapiens
  Payload ID: 287;
  Gene Symbol:;
  Gene Name: AC073130.2;
  ENSP ID: ENSP00000486045
LEQESEVKKMGKGHEQ

SEQ ID NO: 1106 - protein, 126 aa, Homo sapiens
  Payload ID: 288;
  Gene Symbol:;
  Gene Name: AC073333.1;
  ENSP ID: ENSP00000485072
MVMTLNEHAAFKHLFNKAHLAPPLIHLTLSGHSTCFREHRVGGKVIDQQDPKAEEFFLVQNKMKSLPCLLLSTQTQQPSDFSIFSPPFPLFYSTKPPLSSWPVLNELLGTPPRRGGGRAEGLLTSQ

SEQ ID NO: 1107 - protein, 62 aa, Homo sapiens
  Payload ID: 289;
  Gene Symbol:;
  Gene Name: AC073610.5;
  ENSP ID: ENSP00000443189
NKQDLPNAMNAAEITDKLGLHSLRHRNWYIQATCATSGDGLYEGLDWLANQLKNKNGCSGAV

SEQ ID NO: 1108 - protein, 60 aa, Homo sapiens
  Payload ID: 290;
  Gene Symbol:;
  Gene Name: AC073657.1;
  ENSP ID: ENSP00000485571
KNQSFFFLRRSFALSPRLECSGAISAHCKLCLPGSRHSPAPATREAEARESLEPGRWRLQ

SEQ ID NO: 1109 - protein, 15 aa, Homo sapiens
  Payload ID: 291;
  Gene Symbol:;
  Gene Name: AC074033.1;
  ENSP ID: ENSP00000486275
SGSNFDPFLQKLLKI

SEQ ID NO: 1110 - protein, 215 aa, Homo sapiens
  Payload ID: 292;
  Gene Symbol:;
  Gene Name: AC079355.1;
  ENSP ID: ENSP00000484537
TASGRWASPGPAWASRRPLQAQVVLKSASPGPAPASQQASSFGSAPAQLPPAFVDPELSPAKLLSPTSCLPVACTGPGLAGEQPLQAPLLPPRGVSRPSSRLTAASRDQVPACLPAACVRPSSSVTVACGPTHASGTLSRGVSPCLTLASLTLREVSVSPCLTLASLTLREVSVSPCLTLASLTLREVLPHAGLLRPSSCLCWLLLAQPLPVGGL

SEQ ID NO: 1111 - protein, 21 aa, Homo sapiens
  Payload ID: 293;
  Gene Symbol:;
  Gene Name: AC079907.1;
  ENSP ID: ENSP00000486880
NRFSLIVDHETGSCSVTQAGV

SEQ ID NO: 1112 - protein, 598 aa, Homo sapiens
  Payload ID: 294;
  Gene Symbol:;
  Gene Name: AC084219.2;
  ENSP ID: ENSP00000467018
MIDSGEKKPGRRAEEAVTFKDVAVIFTEEELGLLDPAQRKLYRDVMLENFRNLLSVGHQPFHGDTFHFLREEKFWVMGTTSQREGNLGTILLSLELCHSGLCKFPKVGGKMTMSKEAVTFKDVAVVFTEEELGLLDLAQRKLYRDVMLENFRNLLSVGHQPFHRDTFHFLREEKFWMMDIATQREGNSGGKIQPEMKTFPEAGPHEGWSCQQIWEEIASDLTRPQDSTIKSSQFFEQGDAHSQVEEGLSIMHTGQKPSNCGKCKQSFSDMSIFDLPQQIRSAEKSHSCDECGKSFCYISALHIHQRVHLGEKLFKCDVCGKEFSQSLHLQTHQRVHTGEKPFKCEQCGRGFRCRSALTVHCKLHMGEKHYNCEACGRAFIHDFQLQKHQRIHTGEKPFKCEICSVSFRLRSSLNRHCVVHTGKKPNSTGEYGKGFIRRLDLCKHQTIHTGEKPYNCKECGKSFRRSSYLLIHQRVHTGEKPYKCDKCGKSYITKSGLDLHHRAHTGERPYNCDDCGKSFRQASSILNHKRLHCRKKPFKCEDCGKKLVYRSYRKDQQKNHSGENPSKCEDCGKRYKRRLNLDIILSLFLNDTHNSVFS

SEQ ID NO: 1113 - protein, 32 aa, Homo sapiens
  Payload ID: 295;
  Gene Symbol:;
  Gene Name: AC087350.1;
  ENSP ID: ENSP00000487350
FLVLKKFKGLTFTQSKCFSKVMLYPGPSYYIV

SEQ ID NO: 1114 - protein, 19 aa, Homo sapiens
  Payload ID: 296;
  Gene Symbol:;
  Gene Name: AC087392.1;
  ENSP ID: ENSP00000486177
CSTVRLECTGMISAHCNLC

SEQ ID NO: 1115 - protein, 21 aa, Homo sapiens
  Payload ID: 297;
  Gene Symbol:;
  Gene Name: AC087651.1;
  ENSP ID: ENSP00000487442
RALRPSVLPGSTVRIKPELGG

SEQ ID NO: 1116 - protein, 21 aa, Homo sapiens
  Payload ID: 298;
  Gene Symbol:;
  Gene Name: AC087651.2;
  ENSP ID: ENSP00000486689
QMQKAVQSSLKRWGFTILARL

SEQ ID NO: 1117 - protein, 174 aa, Homo sapiens
  Payload ID: 299;
  Gene Symbol:;
  Gene Name: AC087762.1;
  ENSP ID: ENSP00000485301
MLCPCLGTASFPLPIWLPAAPCVPTPPAPVFGWPPLPAEPVPLRSCQQWGCARPPPVLQGAGFLLRPSRVSSSSAPCTRSADLTESAPLLQLALASCLPLSDPVVFCLLGLPPGLAAVSLPQLVFWGISNLPELPLPIWSPDLGSTTPLQNSPPSTPPWGLQAPSKEQQDSPSQ

SEQ ID NO: 1118 - protein, 57 aa, Homo sapiens
  Payload ID: 300;
  Gene Symbol:;
  Gene Name: AC090154.1;
  ENSP ID: ENSP00000485600
GWARWLTPVIPALWETEAGGSPEVRSSRPAWPTWRNPVSTKMTKLLQIYELMLEYQA

SEQ ID NO: 1119 - protein, 25 aa, Homo sapiens [sequence omitted]

SEQ ID NO: 1120 - protein, 107 aa, Homo sapiens
  Payload ID: 302;
  Gene Symbol:;
  Gene Name: AC090958.1;
  ENSP ID: ENSP00000487458
MALQTLQSSWVTFRKILSHFPEELSLAFVYGSGVYRQAGPSSDQKSYLTAASRTCWLPYPQSTFLQHGSLPFPVLPPVLPASLFNSRVLQDSDLSSLGEFLPPVPLI

SEQ ID NO: 1121 - protein, 17 aa, Homo sapiens
  Payload ID: 303;
  Gene Symbol:;
  Gene Name: AC091180.1;
  ENSP ID: ENSP00000486343
SKVEQNTTPSPHPPQPE

SEQ ID NO: 1122 - protein, 25 aa, Homo sapiens [sequence omitted]

SEQ ID NO: 1123 - protein, 46 aa, Homo sapiens
  Payload ID: 305;
  Gene Symbol:;
  Gene Name: AC092159.1;
  ENSP ID: ENSP00000485157
MAVTTFRRNIPIKTQQIWKTEHMKQKYLKIFRNLENLNYILRHRMS

SEQ ID NO: 1124 - protein, 16 aa, Homo sapiens
  Payload ID: 306;
  Gene Symbol:;
  Gene Name: AC092384.1;
  ENSP ID: ENSP00000486761
ADGDRQLLQQKVRSFP

SEQ ID NO: 1125 - protein, 306 aa, Homo sapiens
  Payload ID: 307;
  Gene Symbol:;
  Gene Name: AC092718.1;
  ENSP ID: ENSP00000485105
MGEDSPVAMFSWYLDNTPTEQAEPLLDACRLRGFWPRSLTLLQSNTSTLLLNSSFLQSRGEVIRIRATALTRHAYGEDTYVISTVPPREVPACTIAPEEGTVLTSFAIFCNASTALGPLEFCFCLESGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVREHVLGSLSAVTTGLEDVQRVQELAEVLREVTCRSKELTPSAQGSCMGDSWEGAPPAAHVSHAR

SEQ ID NO: 1126 - protein, 522 aa, Homo sapiens
  Payload ID: 308;
  Gene Symbol:;
  Gene Name: AC092835.2;
  ENSP ID: ENSP00000478941
MEPEGRGSLFEDSDLLHAGNPKENDVTAVLLTPGSQELMIRDMAEALTQWRQLNSPQGDVPEKPRNLVLLGLPISTPDVISQLEHEEELEREVSKAASQKHWETIPESKELTPEKDISEEESAPGVLIVRFSKESSSECEDSLESQQENHEKHLIQEAVTEKSSRERSYQSDEFRRNCTQRSLLVQQQGERLHHCDSFKNNLKQNSDIIRHERICAGKKPWKCNECEKAFSYYSAFVLHQRIHTGEKPYECNECGKAFSQSIHLTLHQRIHTGEKPYECHECGKAFSHRSALIRHHIIHTGEKPYECNECGKAFNQSSYLTQHQRIHTGEKPYECNECGKAFSQSTFLTQHQVIHTGEKPYKCNECGKAFSDRSGLIQHQRTHTGERPYECNECGKAFGYCSALTQHQRTHTGEKPYKCNDCAKAFSDRSALIRHQRTHTGEKPYKCKDCGKAFSQSSSLTKHQKTHTGEKPYKCKECGKAFSQSSSLSQHQKTHAGVKTKKYVQALSEHLTFGQHKRIHTG

SEQ ID NO: 1127 - protein, 123 aa, Homo sapiens
  Payload ID: 308;
  Gene Symbol:;
  Gene Name: AC092835.2;
  ENSP ID: ENSP00000482715
MEPEGRGSLFEDSDLLHAGNPKENDVTAVLLTPGSQELMIRDMAEALTQWRQLNSPQGDVPEKPRNLVLLGLPISTPDVISQLEHEEELEREVSKAASQKRNSLGDNSPLKNVPFFWRKEGTF

SEQ ID NO: 1128 - protein, 118 aa, Homo sapiens
  Payload ID: 309;
  Gene Symbol:;
  Gene Name: AC092881.1;
  ENSP ID: ENSP00000485076
MQLEYKSMFIGFYSYHSMYSIHVNYWMKSPIIYIFGYNHTILELKTIQVSVPAFSGYLMALHNHFHPNLAKSKFKHFCIYSKTNSLSCLISVTLTSREGTLPSISLPPLTFLTIKNIQ

SEQ ID NO: 1129 - protein, 20 aa, Homo sapiens
  Payload ID: 310;
  Gene Symbol:;
  Gene Name: AC100821.2;
  ENSP ID: ENSP00000487589
ELMQEVKNISIKLENLRWYP

SEQ ID NO: 1130 - protein, 300 aa, Homo sapiens
  Payload ID: 311;
  Gene Symbol:;
  Gene Name: AC104057.1;
  ENSP ID: ENSP00000485196
MRGPDQMEIRGGPYLLLGEVVGHSALGAQPAQAANGDADELLELSALLQPRAGRGPCATLSGRCITPATALLLLSHRLRAQCRPMQATAAEAGSPGLGRLGKEPPSRESWTGSAPRRCPCQDASRAGSGVCRSRPQSRGGGSRKPRRQKAAATGQKAAAAQAKSLGGGGKKPRRQKCAAGQKAAAEESRRGGGKKPRRGGQKAVGAGAKKPQKAAAAGTKTPRRRRQKAAKAAVWGQKAAAGESLTPNSLASVSFSRPMFLRHYPFSSCECKSHKHGSTFDHFNCLTFHVTRPSTIESMY

SEQ ID NO: 1131 - protein, 301 aa, Homo sapiens
  Payload ID: 312;
  Gene Symbol:;
  Gene Name: AC104073.2;
  ENSP ID: ENSP00000485644
MRGPDQMEIRGGPYLLLGEVVGHSALGAQPAQAANGDADELLELSALLQPRAGRGPCATLSGRCITPATALLLLSHRLRAQCRSMQATAAEAGSPGLWRLGKEPPSRESWTGSAPRRCPCQDASRAGSGVCRSRPQSRGGGSRKPRRQKAAATGQKAAAAQAKSLGGGGKKPRRQKCAAAGQKAAAEESRRGGGKKPRRGGQKAVGAGAKKPQKAAAAGTKTPRQRRQKAAKAAVWGQKAAAGESLTPNSLASVSFSRPMFLRHYPFSSCECKSHKHGSTFDHFNCLTFHVTRPSTIESMY

SEQ ID NO: 1132 - protein, 137 aa, Homo sapiens
  Payload ID: 313;
  Gene Symbol:;
  Gene Name: AC104389.1;
  ENSP ID: ENSP00000485458
MDCQNGHQHISQELEVLRIHMQLVTVQFTQLGKGALEIIQVLYGISQGSQHLLAMCLDFGVAHDGRGRGQVAKAVKEPLGPWVDNQEPPSQGFSSSIFHIHLAPQACDSSLVLLCEMTHGVWTRSLLITSDVPEASV

SEQ ID NO: 1133 - protein, 137 aa, Homo sapiens
  Payload ID: 314;
  Gene Symbol:;
  Gene Name: AC104389.2;
  ENSP ID: ENSP00000485381
MDCQNGHQHISQELEVLRIHMQLVTVQFTQLGKGALEIIQVLCGISQGSQHLLAMCLDFGVAHDGRGRGQVAKAVKEPLGPWVDNQEPPSQGFSSSIFHIHLAPQACDSSLVLLCEMTHGVWTRSLLITSDVPEASV

SEQ ID NO: 1134 - protein, 68 aa, Homo sapiens
  Payload ID: 315;
  Gene Symbol:;
  Gene Name: AC104532.2;
  ENSP ID: ENSP00000468419
MSAPPALQIREANAHLAAVHRRAAELEARLDAAERTVHAQAERLALHDQQLRAALDELGRAKDRGTFH

SEQ ID NO: 1135 - protein, 321 aa, Homo sapiens
  Payload ID: 316;
  Gene Symbol:;
  Gene Name: AC104534.3;
  ENSP ID: ENSP00000470059
  MOD_RES (1)..(1): Any amino acid
XMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPRLTGSNYPGLSISLRLTGSSAQEEASGVALGEAPDHSYESLRVTSAQKHVLHVQLNRPNKRNAMNKVFWREMVECFNKISRDADCRAVVISGAGKMFTAGIDLMDMASDILQPKGDDVARISWYLRDIITRYQE

SEQ ID NO: 1136 - protein, 114 aa, Homo sapiens
  Payload ID: 316;
  Gene Symbol:;
  Gene Name: AC104534.3;
  ENSP ID: ENSP00000471066
  MOD_RES (1)..(1): Any amino acid
XMVYGLDQSKMNCDRVFNVFCLYGNVEKICDELGVKRPSSVKVFSGKSERSSSGLLEWESKSDALETLGFLNHYQMKNPSIDLMDMASDILQPKGDDVARISWYLRDIITRYQE

SEQ ID NO: 1137 - protein, 114 aa, Homo sapiens; identical to SEQ ID NO: 1136
  Payload ID: 316;
  Gene Symbol:;
  Gene Name: AC104534.3;
  ENSP ID: ENSP00000489000
  MOD_RES (1)..(1): Any amino acid

SEQ ID NO: 1138 - protein, 321 aa, Homo sapiens; identical to SEQ ID NO: 1135
  Payload ID: 316;
  Gene Symbol:;
  Gene Name: AC104534.3;
  ENSP ID: ENSP00000489028
  MOD_RES (1)..(1): Any amino acid

SEQ ID NO: 1139 - protein, 16 aa, Homo sapiens
  Payload ID: 317;
  Gene Symbol:;
  Gene Name: AC104581.1;
  ENSP ID: ENSP00000487284
LWTRSLYLFGRNGVCL

SEQ ID NO: 1140 - protein, 28 aa, Homo sapiens
  Payload ID: 318;
  Gene Symbol:;
  Gene Name: AC104650.2;
  ENSP ID: ENSP00000487144
QNLPSTVSQAPLPYGRGPCRPQGGGSVR

SEQ ID NO: 1141 - protein, 124 aa, Homo sapiens [sequence omitted]

SEQ ID NO: 1142 - protein, 20 aa, Homo sapiens
  Payload ID: 320;
  Gene Symbol:;
  Gene Name: AC105009.1;
  ENSP ID: ENSP00000486401
EISPGAMDRVIRQFHYFQTN

SEQ ID NO: 1143 - protein, 160 aa, Homo sapiens [sequence omitted]

SEQ ID NO: 1144 - protein, 43 aa, Homo sapiens [sequence omitted]

SEQ ID NO: 1145 - protein, 124 aa, Homo sapiens [sequence omitted]

SEQ ID NO: 1146 - protein, 248 aa, Homo sapiens
  Payload ID: 324;
  Gene Symbol:;
  Gene Name: AC108938.5;
  ENSP ID: ENSP00000473841
MAFSGRARPCIIPENEEIPRAALNTVHEANGTEDERAVSKLQRRHSDVKVYKEFCDFYAKFNMANALASATCERCKGGFAPAETIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGQEGSDCRCTGAERGAILPAMP

SEQ ID NO: 1147 - protein, 229 aa, Homo sapiens
  Payload ID: 325;
  Gene Symbol:;
  Gene Name: AC109344.1;
  ENSP ID: ENSP00000485520
MSPLIMGLDVNPDACLTALLDICKLLEAVCPSSPTSSGHEIPTQLLGKDLQSSLCPPFPLAWALLLPTPLLSFHPEGCAPSHSHCLACHLSLHPVQTSSSGLLAHQPVMGWMPKCRAKLMHLLLMSFSVCLMTSGDPSSSARQPRSPTLASAYLPSHGRQHPQSREVCASGTWNMQGFADRAPCYFLCPSHSLQNPHCSPVTTCALLIPSAPISHSPAILTPSATFLIP

SEQ ID NO: 1148 - protein, 124 aa, Homo sapiens
  Payload ID: 326;
  Gene Symbol:;
  Gene Name: AC109486.1;
  ENSP ID: ENSP00000485453
MTLNEHAAFKHLFNKAHLAPPLIHLTLSGHSTCFREHRVGGKVTDQQDPKAEEFFLVQNKMKSLPCLPLSTQTQQPSDFSIFSPPFPPFYSTKPPLSSWPVLNELLGTPPRWGGGRAEGLLTSQ

SEQ ID NO: 1149 - protein, 261 aa, Homo sapiens
  Payload ID: 327;
  Gene Symbol:;
  Gene Name: AC109829.1;
  ENSP ID: ENSP00000403181
MAPIWGMDVPLPSDISLLLLFVFFIWRLWTLFSRNRSWKQVAAKINSETSKQHRLKKIQKLTGQRDPILYSSAQDPQWEENLRMACTEANLTCVSELPVGWTQEYILWSMERSLQQIFRYLESARSRLVEQDLPESQDMISSSTTSVLVAQKTVLCCCDYKKAKHSTDHSISFSSSCNDSSLSHLPVFSEGTTWEFRSHSLPISHKKQSSVFRNQGRTLPLFQLSEPQKSKIFQNLADLSPLQPQSSFINSISEPLNICKQ

SEQ ID NO: 1150 - protein, 124 aa, Homo sapiens [sequence omitted]

SEQ ID NO: 1151 - protein, 36 aa, Homo sapiens
  Payload ID: 329;
  Gene Symbol:;
  Gene Name: AC110602.1;
  ENSP ID: ENSP00000487518
IREAGSSDSPTSPSRVAGNIILTPQACMFVKQLYLS

SEQ ID NO: 1152 - protein, 92 aa, Homo sapiens
  Payload ID: 330;
  Gene Symbol:;
  Gene Name: AC110615.1;
  ENSP ID: ENSP00000485507
MENLPGSYFILFLFFKSASRSANCFSRKERLFFDRTFWLYRIIIKFFCFFFSLFVELENGFVLVFFLTNSFRSVFPAIAVASLVSLSDFGFL

SEQ ID NO: 1153 - protein, 30 aa, Homo sapiens
  Payload ID: 331;
  Gene Symbol:;
  Gene Name: AC112719.2;
  ENSP ID: ENSP00000487114
SSVRVFNSDPEQPSKIGAIVIYILQKRKQA

SEQ ID NO: 1154 - protein, 156 aa, Homo sapiens
  Payload ID: 332;
  Gene Symbol:;
  Gene Name: AC118758.1;
  ENSP ID: ENSP00000469705
MASGRWAPPGPAWASQRPLQTQVVLKSASPGPAPASRQAICFGSAPAQLPLAFGGPKLSPAKLFRPTSCLPVACTGPALAGEQPLQAPLLPPRGLSRPSSRPTVASWGQVPACLPAARERPSSSLTVACLGPTRVSGTLSRGVSPCLTLASLMLRE

SEQ ID NO: 1155 - protein, 96 aa, Homo sapiens
  Payload ID: 333;
  Gene Symbol:;
  Gene Name: AC123512.1;
  ENSP ID: ENSP00000485642
MNVCCSSHPVNEKVWKPSSRKWSSKVWSMDEFDLQTACYWFMTRSTNCILRAQISREQCNLSQKDDYVYALSCLFPCLTQRRHKEKVSSAWINWRL

SEQ ID NO: 1156 - protein, 85 aa, Homo sapiens
  Payload ID: 334;
  Gene Symbol:;
  Gene Name: AC123512.2;
  ENSP ID: ENSP00000485548
MNVCCSSHPVNEKVWKPSSRKWSSKVWSMDEFDLQTACYWFMTRSTNCILRAQISREQCNLSQKDDYVYALSCVCMCMYIRYFHA

SEQ ID NO: 1157 - protein, 138 aa, Homo sapiens
  Payload ID: 335;
  Gene Symbol:;
  Gene Name: AC124312.1;
  ENSP ID: ENSP00000485422
MEPIYRVLSRKKISITNLLTTDFHCCYENTMGTKKSSAMKKNEPKNNKDVALGSLPNHKELSTSGEQGNPEPALKDKPGHTEAGYRLTLLCHLHIHPVLQTLCVLPSLTKRSPSHKESPLHRSTYCPVTPFDPKWTPS

SEQ ID NO: 1158 - protein, 32 aa, Homo sapiens
  Payload ID: 336;
  Gene Symbol:;
  Gene Name: AC126407.1;
  ENSP ID: ENSP00000486685
APPAAPRSALAESGAADSPEGSQTGRSGPDTP

SEQ ID NO: 1159 - protein, 133 aa, Homo sapiens
  Payload ID: 337;
  Gene Symbol:;
  Gene Name: AC129492.1;
  ENSP ID: ENSP00000485311
MQPTLSAVSSCTAPPRPRSRRSTRPPSSRLNRSRSRSTSGSIGGMAGVGVGAGAGQGRAGAEGGGGGAPLRRILSCRLLATKWVRSPWRLTVPSSSRGLEMVARRPPPAPDSALPEDPAPPHASLSPSRLRLS

SEQ ID NO: 1160 - protein, 198 aa, Homo sapiens
  Payload ID: 338;
  Gene Symbol:;
  Gene Name: AC130310.1;
  ENSP ID: ENSP00000484037
MGLQQQTGTQQLEPHPPQPEPQPPLDPPQEPQPPLEPPQEPQPPLDPPQEHSPPCSLHRSHSPPWSPQKSHSPLCHSWSRNRLAHGSTRACSSRRAHSSWSQNLHSQSHSPHSRSHSPHSRSHSPHSWSHSLRSSRNSPWFWWIEGGAGRGAGEREVQVWSSLSLDPLYPCPGSCVRLGTHFLVPVCAIFRAPFSCFL

SEQ ID NO: 1161 - protein, 57 aa, Homo sapiens
  Payload ID: 339;
  Gene Symbol:;
  Gene Name: AC131263.1;
  ENSP ID: ENSP00000487024
DRVSLCCPGWNVVVLSQLTAASASAGLKLLTSGDLPASASQSAGIIGVSHHARLTCK

SEQ ID NO: 1162 - protein, 102 aa, Homo sapiens
  Payload ID: 340;
  Gene Symbol:;
  Gene Name: AC133551.1;
  ENSP ID: ENSP00000479378
MRASPCISQPAASWHPRPSALRPTAGSGPDTRTPGTVEDGSAPCPAFRSPAVSPCGEEPCCFQISPAEETLELGRLVSPGCHKSSAPQERRLDPRARCVVHI

SEQ ID NO: 1163 - protein, 581 aa, Homo sapiens
  Payload ID: 341;
  Gene Symbol:;
  Gene Name: AC136352.4;
  ENSP ID: ENSP00000478796
MVAEVCSMPAASAVKKPFDLRSKMGKWCHHRFPCCRGSGKSNMGTSGDHDDSFMKTLRSKMGKCCHHCFPCCRGSGTSNVGTSGDHDNSFMKTLRSKMGKWCCHCFPCCRGSGKSNVGTWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADGNIQDEYGNTALHYAIYNEDKLMAKALLLYGADIESKNKCGLTPLLLGVHEQKQEVVKFLIKKKANLNALDRYGRTALILAVCCGSASIVNLLLEQNVDVSSQDLSGQTAREYAVSSHHHVICELLSDYKEKQMLKISSENSNPEQDLKLTSEEESQRLKVSENSQPEKMSQEPEINKDCDREVEEEIKKHGSNPVGLPENLTNGASAGNGDDGLIPQRKSRKPENQQFPDTENEEYHSDEQNDTQKQLSEEQNTGISQDEILTNKQKQIEVAEKEMNSELSLSHKKEEDLLRENSMLREEIAMLRLELDETKHQNQLRENKILEEIESVKEKLLKAIQLNEEALTKTSI

SEQ ID NO: 1164 - protein, 381 aa, Homo sapiens
  Payload ID: 341;
  Gene Symbol:;
  Gene Name: AC136352.4;
  ENSP ID: ENSP00000479796
MVAEVCSMPAASAVKKPFDLRSKMGKWCHHRFPCCRGSGKSNMGTSGDHDDSFMKTLRSKMGKCCHHCFPCCRGSGTSNVGTSGDHDNSFMKTLRSKMGKWCCHCFPCCRGSGKSNVGTWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADGNIQDEYGNTALHYAIYNEDKLMAKALLLYGADIESKNKCGLTPLLLGVHEQKQEVVKFLIKKKANLNALDRYGRTALILAVCCGSASIVNLLLEQNVDVSSQDLSGQTAREYAVSSHHHVICELLSDYKEKQMLKISSENSNPGKEAEE

SEQ ID NO: 1165 - protein, 199 aa, Homo sapiens
  Payload ID: 342;
  Gene Symbol:;
  Gene Name: AC136352.5;
  ENSP ID: ENSP00000482263
MALLLRFVLLCRVADFIRGWSITTPEQMIEKAKGETAYLPCKFTLSPEDQGPLDIEWLISPADNQKVDQVIILYSGDKIYDDYYPDLKGRVHFKSNDLKSGDASINVTNFQLSDIGTDQCKVKRAPGVANRKIQLVVLGKMCRLQRAARPLPEATAVIIHPWDPYLLPTWKDIPRLSINKYQVKTLNALLRVRLSHLLR

SEQ ID NO: 1166 - protein, 124 aa, Homo sapiens
  Payload ID: 343;
  Gene Symbol:;
  Gene Name: AC136612.1;
  ENSP ID: ENSP00000482038
MRASPCISQPAASWHPRPSALRPTAGSGPDTRTPGTVEDGSAPCPAFRSPAVSPCGEEPCCFQISPAEETLELGRLVSPGNCDTLSPRAAGFYACHVRSLIPCRSTKGRWPLTASAAGLSSFSG

SEQ ID NO: 1167 - protein, 635 aa, Homo sapiens
  Payload ID: 344;
  Gene Symbol:;
  Gene Name: AC136616.1;
  ENSP ID: ENSP00000480079
MAKKSAENGICSVSGDQKKGPLIAPGPDGARAKGDGPAGLGTPGGGLAVPARATWTRQMDFIMSCVGFAVDLGNVWRFPYLCYKNGGGVFLIPCILIALVGGIPIFFLEISLGQFMKAGSINVWNICPLFKGLGYASMVIVFYCNTYYIMVLAWGFYYLVKSFTTTLPWATCGHTWNTPDCVEIFRHEDCASASLANLTCDQLADRRSPVIEFWENKVLRLSGGLEVPGALNWEVTLCLLACWVLVYFCVKGVKSMGKIVYFTATFPYVVLVVLLVLGVLLPGTLDSIIYYLKPDWSKLGSPQVWIDVGTQIFFSYAIGLGALTALGSYNRFNNNCYKDAIILAVINSGTSFFAGFVVFSILGFMAAEQGMHISKVAESGPGLAFIAYPQAVTLMPVAPLWAALFFFMLLLLGLDSQFVGVEGFITGLLNLLPASYYFCFQREISVALCCALRFVIDLSMVTDGGMYVFQLFDYYSASGTTLLWQAFWECVVVAWVYGADRFTDDIACMIGYRPCPWMKWCWSFFTPLVCMGIFIFNVVYYEPLVYNNTNVYPWWGEAMGWAFVLSSMLCMPLHLLGCLLRAKGTMAECWKHLTQTIWGLHHLEYRAQDADVRGLTTLTPVSESSKVVVVESVMG

SEQ ID NO: 1168 - protein, 520 aa, Homo sapiens
  Payload ID: 344;
  Gene Symbol:;
  Gene Name: AC136616.1;
  ENSP ID: ENSP00000482251
MKAGSINVWNICPLFKGLGYASMVIVFYCNTYYIMVLAWGFYYLVKSFTTTLPWATCGHTWNTPDCVEIFRHEDCASASLANLTCDQLADRRSPVIEFWENKVLRLSGGLEVPGALNWEVTLCLLACWVLVYFCVKGVKSMGKIVYFTATFPYVVLVVLLVLGVLLPGTLDSIIYYLKPDWSKLGSPQVWIDVGTQIFFSYAIGLGALTALGSYNRFNNNCYKDAIILAVINSGTSFFAGFVVFSILGFMAAEQGMHISKVAESGPGLAFIAYPQAVTLMPVAPLWAALFFFMLLLLGLDSQFVGVEGFITGLLNLLPASYYFCFQREISVALCCALRFVIDLSMVTDGGMYVFQLFDYYSASGTTLLWQAFWECVVVAWVYGADRFTDDIACMIGYRPCPWMKWCWSFFTPLVCMGIFIFNVVYYEPLVYNNTNVYPWWGEAMGWAFVLSSMLCMPLHLLGCLLRAKGTMAECWKHLTQTIWGLHHLEYRAQDADVRGLTTLTPVSESSKVVVVESVMG

SEQ ID NO: 1169 - protein, 112 aa, Homo sapiens
  Payload ID: 345;
  Gene Symbol:;
  Gene Name: AC136616.2;
  ENSP ID: ENSP00000479675
AILKGVQCEVQLVESAGGLVQPGGSLRLSCAASGFTCSNAWMSWVRQAPGKGLEWVGRIKSKANGGTTDYAAPVKGRFTISRVDSKNTLYLQMNSLKTEDTAVYYCTTGGGV

SEQ ID NO: 1170 - protein, 75 aa, Homo sapiens
  Payload ID: 345;
  Gene Symbol:;
  Gene Name: AC136616.2;
  ENSP ID: ENSP00000484138
ASGFTCSNAWMSWVRQAPGKGLEWVGRIKSTGGGTYYADSVKGRFTISRDNAKNSLYLQMNSLRAEDMAVYYCAR

SEQ ID NO: 1171 - protein, 95 aa, Homo sapiens
  Payload ID: 346;
  Gene Symbol:;
  Gene Name: AC136616.3;
  ENSP ID: ENSP00000479119
QVQLLQPGAEVKKPGSSVKVSCQASGYTFTSYDIHCVRQAPGGFERMGGIYSGNGKTGYAQKFQGRVTMTRDMSTSTAYMELSSQRSEDIDVYYC

SEQ ID NO: 1172 - protein, 24 aa, Homo sapiens
  Payload ID: 347;
  Gene Symbol:;
  Gene Name: AC138028.1;
  ENSP ID: ENSP00000487195
LTPVGEAFGDCSPSIPPPWPRPTR

SEQ ID NO: 1173 - protein, 153 aa, Homo sapiens
  Payload ID: 348;
  Gene Symbol:;
  Gene Name: AC138969.4;
  ENSP ID: ENSP00000330634
MAAVEHRHSSGLPYWPYLTAETLKNRMGHQPPPPTQQHSIIDNSLSLKTPSECVLYPLPPSADDNLKTPPECLLTPLPPSALPSADDNLKTPAECLLYPLPPSADDNLKTPPECLLTPLPPSAPPSADDNLKTPPECVCSLPFHPQRMIISRN

SEQ ID NO: 1174 - protein, 369 aa, Homo sapiens
  Payload ID: 348;
  Gene Symbol:;
  Gene Name: AC138969.4;
  ENSP ID: ENSP00000370908
MFCCLGYEWLSGGCKTWHSAWVINTLADHRHRGTDFGGSPWLLIITVFLRSYKFAISLCTSYLCVSFLKTIFPSQNGHDGSTDVQQRARRSNCRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECVLYPLPPSADDNLKTPPECLLTPLPPSALPSADDNLKTPAECLLYPLPPSADDNLKTPPECLLTPLPPSAPPSADDNLKTPPECVCSLPFHPQRMIISRN

SEQ ID NO: 1175 - protein, 270 aa, Homo sapiens
  Payload ID: 348;
  Gene Symbol:;
  Gene Name: AC138969.4;
  ENSP ID: ENSP00000435610
  MOD_RES (1)..(1): Any amino acid
XRHRGTDFGGSPWLLIITVFLRSYKFAISLCTSYLCVSFLKTIFPSQNGHDGSTDVQQRARRSNCRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVSLLVFLAFGHSLPGQDMDTFFSLRLCAQALQREMAERKAAYKHHSPIPVGNCVAQKHLHPHPVGPPSNILSIRGSVFVIANGP

SEQ ID NO: 1176 - protein, 114 aa, Homo sapiens
  Payload ID: 348;
  Gene Symbol:;
  Gene Name: AC138969.4;
  ENSP ID: ENSP00000436257
AKIRKMKVTTKVNRHDKINGKRKTAKEHLRKLSMKEREHGEKERQVSEAEENGKLDMKEIHTYMEMFQRAQALRRRAEDYYRCKITPSARKPLCNRCTYNLVLPGSEKKYYSHA

SEQ ID NO: 1177 - protein, 232 aa, Homo sapiens
  Payload ID: 348;
  Gene Symbol:;
  Gene Name: AC138969.4;
  ENSP ID: ENSP00000441983
MFCCLGYEWLSGGCKTWHSAWVINTLADHRHRGTDFGGSPWLLIITVFLRSYKFAISLCTSYLCVSFLKTIFPSQNGHDGSTDVQQRARRSNCRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRCTYNLVLPGSEKKYYSHA

SEQ ID NO: 1178 - protein, 96 aa, Homo sapiens
  Payload ID: 349;
  Gene Symbol:;
  Gene Name: AC141272.1;
  ENSP ID: ENSP00000478725
EVQLVESGGGLVQPGGSLRLSCAASGFTFSNHYTSWVRQAPGKGLEWVSYISGNSGYTNYADSVKGRFTISRDNAKNSLYLQMNSLRAEDTAVYYC

SEQ ID NO: 1179 - protein, 25 aa, Homo sapiens
  Payload ID: 350;
  Gene Symbol:;
  Gene Name: AC142525.1;
  ENSP ID: ENSP00000485802
QRSPRWEDSYPSAWEGFKENQTGSL

SEQ ID NO: 1180 - protein, 129 aa, Homo sapiens
  Payload ID: 351;
  Gene Symbol:;
  Gene Name: AC145212.2;
  ENSP ID: ENSP00000478910
MFPVSSGCFQEQQETNKSLPRSASTPETRTKFTQDNLCHAQRERLDSANLWVLVDCILRDTSEDLGLQCDAVNLAFGRRCEELEDARHKLQHHLHKMLREITDQEHNVVALKEAIKDKEEPLHIAQTRL

SEQ ID NO: 1181 - protein, 43 aa, Homo sapiens
  Payload ID: 352;
  Gene Symbol:;
  Gene Name: AC156455.2;
  ENSP ID: ENSP00000486263
MTALFPGLAPETEQPDIHTPRRQLEVPPGNQNHPQRRPPDTDI

SEQ ID NO: 1182 - protein, 316 aa, Homo sapiens
  Payload ID: 353;
  Gene Symbol:;
  Gene Name: AC171558.1;
  ENSP ID: ENSP00000480318
MKIANNTVVTEFILLGLTQSQDIQLLVFVLILIFYLIILPGNFLIIFTIRSDPGLTAPLYFFLGNLAFLDASYSFIVAPRMLVDFFSEKKVISYRGCITQLFFLHFLGGGEGLLLVVMAFDRYIAICRPLHCSTVMNPRACYAMMLALWLGGFVHSIIQVVLILRLPFCGPNQLDNFFCDVRQVIKLACTDMFVVELLMVFNSGLMTLLCFLGLLASYAVILCHVRRAASEGKNKAMSMCTTRVIIILLMFGPAIFIYMCPFRALPADKMVSLFHTVIFPLMNPMIYTLRNQEVKTSMKRLLSRHVVCQVDFIIRN

SEQ ID NO: 1183 - protein, 313 aa, Homo sapiens
  Payload ID: 354;
  Gene Symbol:;
  Gene Name: AC171558.2;
  ENSP ID: ENSP00000484075
METANYTKVTEFVLTGLSQTPEVQLVLFVIFLSFYLFILPGNILIICTISLDPHLTSPMYFLLANLAFLDIWYSSITAPEMLIDFFVERKIISFDGCIAQLFFLHFAGASEMFLLTVMAFDLYTAICRPLHYATIMNQRLCCILVALSWRGGFIHSIIQVALIVRLPFCGPNELDSYFCDITQVVRIACANTFPEELVMICSSGLISVVCLIALLMSYAFLLALLKKLSGSGENTNRAMSTCYSHITIVVLMFGPSIYIYARPFDSFSLDKVVSVFNTLIFPLRNPIIYTLRNKEVKAAMRKLVTKYILCKEK

SEQ ID NO: 1184 - protein, 497 aa, Homo sapiens
  Payload ID: 355;
  Gene Symbol: CYP2D6;
  Gene Name: AC208162.1;
  ENSP ID: ENSP00000486407
MGLEALVPLAVIVAIFLLLVDLMHRRQRWAARYSPGPLPLPGLGNLLHVDFQNTPYCFDQLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 1185 - protein, 446 aa, Homo sapiens
  Payload ID: 355;
  Gene Symbol: CYP2D6;
  Gene Name: AC208162.1;
  ENSP ID: ENSP00000487524
MGLEALVPLAVIVAIFLLLVDLMHRRQRWAARYSPGPLPLPGLGNLLHVDFQNTPYCFDQLRRRFGDVFSLQLAWTPVVVLNGLAAVREALVTHGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 1186 - protein, 176 aa, Homo sapiens
  Payload ID: 356;
  Gene Symbol:;
  Gene Name: AC213203.1;
  ENSP ID: ENSP00000478882
MGNHELMTSWLLDVRKNLQSQRELSKFCPEQTEGWRCHRLRWENGRCHRLQGKVGDQLRAPEPSWKEFPIQPASVSASVLFLMTLRVLASGSFMMQRVPPSHPGRLRAPASSWQPGARLRIWRPTTGWSLAATSQRRISSPVVSCGRVAVTRSRTRDSWPWCPSRSPRCVACRLFF

SEQ ID NO: 1187 - protein, 84 aa, Homo sapiens
  Payload ID: 357;
  Gene Symbol:;
  Gene Name: AC231657.1;
  ENSP ID: ENSP00000485675
MEPRTGGAANPKGSRGRPGPLPPACPSALPLLARLDARPLAARAAVDVAALVHRAGATLRLRRKEAFIVLGCKDNNVMDSRLPH

SEQ ID NO: 1188 - protein, 117 aa, Homo sapiens
  Payload ID: 358;
  Gene Symbol:;
  Gene Name: AC233755.1;
  ENSP ID: ENSP00000478289
MKHLWFFLLLVAAPRWVLSQVQLQESGPGLVKPSETLSLTCTVSGYSISSGYYWGWIRQPPGKGLEWIGSIYHSGSTYYNPSLKSRVTISVDTSKNQFSLKLSSVTAADTAVYYCAR

SEQ ID NO: 1189 - protein, 98 aa, Homo sapiens
  Payload ID: 359;
  Gene Symbol:;
  Gene Name: AC233755.2;
  ENSP ID: ENSP00000481152
EVQLVESGGVVVQPGGSLRLSCAASGFTFDDYAMHWVRQAPGKGLEWVSLISWDGGSTYYADSVKGRFTISRDNSKNSLYLQMNSLRAEDTALYYCAK

SEQ ID NO: 1190 - protein, 101 aa, Homo sapiens
  Payload ID: 360;
  Gene Symbol:;
  Gene Name: AC234582.1;
  ENSP ID: ENSP00000485039
AGGAVEPGAGLLSGAEVTPWAAGAVEPGAGLLSGAEVTPWAGGAVEPGAGLVSGAEVTPWAGGAVEPGAGLVSGAEVTPWAWGAVEPGAGLVSGAEVTPWA

SEQ ID NO: 1191 - protein, 101 aa, Homo sapiens
  Payload ID: 361;
  Gene Symbol:;
  Gene Name: AC234582.2;
  ENSP ID: ENSP00000485187
AGGAVEPGAGLVSGAEVTPWAAGAVEPGDGLVSGAEVTPWAGGAVEPGAGLVSGAEVTPWAGGAVEPGAGLVSGAEVTPWAGGAVEPGAGLVSGAEVTPWA

SEQ ID NO: 1192 - protein, 446 aa, Homo sapiens
  Payload ID: 362;
  Gene Symbol:;
  Gene Name: AC236040.1;
  ENSP ID: ENSP00000475794
MGLEALVPLAVIVAIFLLLVDLMHRRQRWAARYSPGPLPLPGLGNLLHVDFQNTPYCFDQLRRRFGDVFSLQLAWTPVVVLNGLAAVREALVTHGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 1193 - protein, 497 aa, Homo sapiens
  Payload ID: 362;
  Gene Symbol:;
  Gene Name: AC236040.1;
  ENSP ID: ENSP00000476060
MGLEALVPLAVIVAIFLLLVDLMHRRQRWAARYSPGPLPLPGLGNLLHVDFQNTPYCFDQLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 1194 - protein, 299 aa, Homo sapiens
  Payload ID: 363;
  Gene Symbol:;
  Gene Name: AC240274.1;
  ENSP ID: ENSP00000478612
MVVSAGPLSSEKAEMNILEMNEKLRPQLAEKKQQFRNLKEKCFVTQLACFLANQQNKYKYEECKDLIKSVLRNERQFKEEKLAEQLKQAEELRQYKVLVHSQERELTQLREKLREGRDASRSLNQHLQALLTPDEPDKSQGQDLQEQLAEGCRLAQQLFQKLSPENDNDHDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRTSVGSSEKGGPRGNRSQAQQGAAG

SEQ ID NO: 1195 - protein, 672 aa, Homo sapiens
  Payload ID: 363;
  Gene Symbol:;
  Gene Name: AC240274.1;
  ENSP ID: ENSP00000478665
MVVSAGPWSSEKAETNILEINEKLRPQLAENKQQFRNLKEKCFVTQLAGFLANRQKKYKYEECKDLIKFMLRNERQFKEEKLAEQLKQAEELRQYKVLVHSQERELTQLREKLREGRDASRSLNQHLQALLTPDEPDKSQGQDLQEQLAEGCRLAQHLVQKLSPENDNDHDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSGTFHSLEEQQVCMAVDIGGHRWDQVKKEDQEATGPRLSRELLDEKGPEVLQDSLDRCYSTPSGYLELTDSCQPYRSAFYILEQQRVGWALDMDEIEKYQEVEEDQDPSCPRLSRELLDEKEPEVLQDSLDRCYSTPSGYLELPDLGQPYRSAVYSLEEQYLGLALDVDRIKKDQEEEEDQGPPCPRLSRELLEAVEPEVLQDSLDRCYSTPSSCLEQPDSCLPYGSSFYALEEKHVGFSLDVGEIEKKGKGKKRRGRRSTKKRRRRGRKEGEEDQNPPCPRLSGMLMEVEEPEVLQDSLDRCYSTPSMYFELPDSFQHYRSVFYSFEEQHISFALDVDNRFLTLMGTSLHLVFQMGVIFPQ

SEQ ID NO: 1196 - protein, 791 aa, Homo sapiens
  Payload ID: 363;
  Gene Symbol:;
  Gene Name: AC240274.1;
  ENSP ID: ENSP00000480818
MVVSAGPWSSEKAETNILEINEKLRPQLAENKQQFRNLKEMFCNSTGRLPGQPTEEIQQYKVLVHSQERELTQLREKLREGRDASRSLNQHLQALLTPDEPDKSQGQDLQEQLAEGCRLAQHLVQKLSPENDEDEDEDVQVEEAEKVLESSAPREVQKAEESKVPEDSLEECAITCSNSHGPCDSNQPHKNINITFEEDKVNSTLVVDRESSHDECQDAVNILPVPGPTSSATNVSMVVSAGPLSSEKAEMNILEMNEKLRPQLAEKKQQFRNLKEKCFVTQLACFLANQQNKYKYEECKDLIKSVLRNERQFKEEKLAEQLKQAEELRQYKVLVHSQERELTQLREKLREGRDASRSLNQHLQALLTPDEPDKSQGQDLQEQLAEGCRLAQQLFQKLSPENDNDHDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSGTFHSLEEQQVCMAVDIGGHRWDQVKKEDQEATGPRLSRELLDEKGPEVLQDSLDRCYSTPSGYLELTDSCQPYRSAFYILEQQRVGWALDMDEIEKYQEVEEDQDPSCPRLSRELLDEKEPEVLQDSLDRCYSTPSGYLELPDLGQPYRSAVYSLEEQYLGLALDVDRIKKDQEEEEDQGPPCPRLSRELLEAVEPEVLQDSLDVIQLLPVVLNSLTPACPMEVPFMHWRKNMLAFLLTWEKL

SEQ ID NO: 1197 - protein, 603 aa, Homo sapiens
  Payload ID: 363;
  Gene Symbol:;
  Gene Name: AC240274.1;
  ENSP ID: ENSP00000484923
VLRNERQFKEEKLAEQLKQAEELRQYKVLVHSQERELTQLREKLREGRDASRSLNQHLQALLTPDEPDKSQGQDLQEQLAEGCRLAQQLFQKLSPENDNDHDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSGTFHSLEEQQVCMAVDIGGHRWDQVKKEDQEATGPRLSRELLDEKGPEVLQDSLDRCYSTPSGYLELTDSCQPYRSAFYILEQQRVGWALDMDEIEKYQEVEEDQDPSCPRLSRELLDEKEPEVLQDSLDRCYSTPSGYLELPDLGQPYRSAVYSLEEQYLGLALDVDRIKKDQEEEEDQGPPCPRLSRELLEAVEPEVLQDSLDRCYSTPSSCLEQPDSCLPYGSSFYALEEKHVGFSLDVGEIEKKGKGKKRRGRRSTKKRRRRGRKEGEEDQNPPCPRLSGMLMEVEEPEVLQDSLDRCYSTPSMYFELPDSFQHYRSVFYSFEEQHISFALDVDNRFLTLMGTSLHLVFQMGVIFPQ

SEQ ID NO: 1198 - protein, 268 aa, Homo sapiens
  Payload ID: 364;
  Gene Symbol:;
  Gene Name: AC241377.2;
  ENSP ID: ENSP00000486219
MRRAPDWVQRQAAPGSKCRVPWQRREFPSRGGRKQPQPGSRQRKQNPISLPGEQNGRKATPQAGALGALGIRGIPSLCQSEGTRWSRRGRRWAERCPPGVLGAGRSLRAQRSRLHSRPPPLSPLRKPGGSNQPRSAAAAGTHEACLQASGTTRGWKYHALPLRLDPRSGHAGSALKAGSCPRLGGGGRGRGEAGAPSRFWLPRSLQQLLPNEPRNADVQTLHPTPSHTRRGQRTGKGALGPRFWKSKNSPANRQSSALDFWITTSISF

SEQ ID NO: 1199 - protein, 268 aa, Homo sapiens [sequence omitted]

SEQ ID NO: 1200 - protein, 25 aa, Homo sapiens
  Payload ID: 366;
  Gene Symbol:;
  Gene Name: AC242988.1;
  ENSP ID: ENSP00000485440
IYNVKSTRRLDLREYKNDRDPEKGC

SEQ ID NO: 1201 - protein, 267 aa, Homo sapiens
  Payload ID: 367;
  Gene Symbol:;
  Gene Name: AC243687.1;
  ENSP ID: ENSP00000482099
MWDQRLVKLALLQHLRAFYGIKVKGVRGQCDRRRHETAATEIGGKIFGVPFNALPHSAVPEYGHIPSFLVDACTSLEEHIHTEGLFRKSGSVIRLKALKNKVDHGEGCLSSAPPCDIAGLLKQFFRELPEPILPADLHEALLKAQQLGTEEKNKAILLLSCLLADHTVHVLRYFFNFLRNVSLRSSENKMDSSNLAVIFAPNLLQTSEGHEKMSSNAEKKGVYQTLSWKRYQPCWVLMVSVLLHHWKALKKVNMKLLVNIREREDNV

SEQ ID NO: 1202 - protein, 164 aa, Homo sapiens
  Payload ID: 368;
  Gene Symbol:;
  Gene Name: AC243756.1;
  ENSP ID: ENSP00000464619
MVNSVVFFDITVDGKPLGRISIKLFADKIPKTAENFRALSTGEKGFRYKGSCFHRIIPGFMCQGGDFTRPNGTDDKSIYGEKFDDENLIRKHTGSGILSMVNAGPNTNGSQLFICTAKTEWLDGKHVAFGKVKERVNIVEAMEHFGYRNSKTSKKITIADCGQF

SEQ ID NO: 1203 - protein, 132 aa, Homo sapiens
  Payload ID: 369;
  Gene Symbol:;
  Gene Name: AC243790.2;
  ENSP ID: ENSP00000481534
FTQTYRRSRQHEQLPGQRHMDLLTGYSKLIQSRLKLLLHLGSQPPVGKTFFFSCWCHPLFHGSKTTPNVWYKFSETALSILNSCQASQLGVRKMPGDMSSSPRVREFSALVAIKEKIHILPTNAKVGSKFGS

SEQ ID NO: 1204 - protein, 124 aa, Homo sapiens [sequence omitted]

SEQ ID NO: 1205 - protein, 96 aa, Homo sapiens
  Payload ID: 371;
  Gene Symbol:;
  Gene Name: AC245015.1;
  ENSP ID: ENSP00000489357
IPAQSLTSLLIRLQGRRLDIILTQTPRSLLTSFGKRHSIFYQATAQVHGEISWFQMKGQGFALVISHISNVPKNVPAWFRGRGSGSNYISISGLQP

SEQ ID NO: 1206 - protein, 102 aa, Homo sapiens [sequence omitted]

SEQ ID NO: 1207 - protein, 268 aa, Homo sapiens
  Payload ID: 372;
  Gene Symbol:;
  Gene Name: AC245100.1;
  ENSP ID: ENSP00000487212
MRRAPDWVQRQAAPGSKCRVPWQRREFPGRGGRKQPQPGSRQRKQNPISLPGEQNGRTATPQAGALGALGIRGIPSLCQSEGTRWSRRGRRWAERCPPGVLGAGRSLRAQGSRLHSRPPPLSPLRKPGGSNQPRSAAAAGTQEACLQASGTTRGWKYHALPLRLDPRSGHSGSAFKASSCPRLGGGGRGRGEAGAPSRFWLPRSLQQLSPNEPRNADVQTLHPTPSHTRRGRRTEKGALGPRFWKSKNSPANRQSSALDFWITTSISF

SEQ ID NO: 1208 - protein, 236 aa, Homo sapiens
  Payload ID: 373;
  Gene Symbol:;
  Gene Name: AC253572.1;
  ENSP ID: ENSP00000485259
MCVTYHSGTGYCKCPEGFLGEYCQHRDPCEKNRCQNGGTCVAQAMLGKATCRCASGFTGEDCQYSTPHPCFVSRPCLNGGTCHMLSRDTYECTCQVGFTGKECQWTDACLSHLCANGSTCTTVANQFSCKCLTGFTGQKCETDVNECDIPGHCQHGGTCLNLPGSYQCQCLQGFTGQYCDRLYVPCAHSPCVNGGTCRQTGDFTFECNCLPETVRRGTELWERDRQVWNGKEHDEN

SEQ ID NO: 1209 - protein, 497 aa, Homo sapiens
  Payload ID: 374;
  Gene Symbol:;
  Gene Name: AC254560.1;
  ENSP ID: ENSP00000486123
MGLEALVPLAMIVAIFLLLVDLMHRHQRWAARYPPGPLPLPGLGNLLHVDFQNTPYCFDQLRRRFGDVFSLQLAWTPVVVLNGLAAVREAMVTRGEDTADRPPAPIYQVLGFGPRSQGVILSRYGPAWREQRRFSVSTLRNLGLGKKSLEQWVTEEAACLCAAFADQAGRPFRPNGLLDKAVSNVIASLTCGRRFEYDDPRFLRLLDLAQEGSKEESGFLREVLNAVPVLLHIPALAGKVLRFQKAFLTQLDELLTEHRMTWDPAQPPRDLTEAFLAKKEKAKGSPESSFNDENLRIVVGNLFLAGMVTTLTTLAWGLLLMILHLDVQLRVQQEIDDVIGQVRRPEMGDQAHMPYTTAVIHEVQRFGDIIPLSVTHMTSHDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 1210 - protein, 444 aa, Homo sapiens
  Payload ID: 374;
  Gene Symbol:;
  Gene Name: AC254560.1;
  ENSP ID: ENSP00000486298
MGLEALVPLAMIVAIFLLLVDLMHRHQRWAARYPPGPLPLPGLGNLHVDFQNTPYCFDQLRRRFGDVFSLQLAWTPVVVLNGLAAVREAMVTRGEDTADRPPAPIYQVLGFGPRSQGRPFRPNGLLDKAVSNVIASLTCGRRFEYDDPRFLRLLDLAQGSKEESGFLREVLNAVPVLLHIPALAGKVLRFQKAFLTQLDELLTEHRMTWDPAQPPRDLTEAFLAKKEKAKGSPESSFNDENLRIVVGNLFLAGMVTTLTTLAWGLLLMILHLDVQLRVQQEIDDVIGQVRRPEMGDQAHMPYTTAVIHEVQRFGDIIPLSVTHMTSHDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 1211 - protein, 445 aa, Homo sapiens
  Payload ID: 375;
  Gene Symbol:;
  Gene Name: AC254788.1;
  ENSP ID: ENSP00000489211
MGLEALVPLAMIVAIFLLLVDLMHRHQRWAARYPPGPLPLPGLGNLHVDFQNTPYCFDQLRRRFGDVFSLQLAWTPVVVLNGLAAVREAMVTRGEDTADRPPAPIYQVLGFGPRSQGRPFRPNGLLDKAVSNVIASLTCGRRFEYDDPRFLRLLDLAQEGLKEESGFLREVLNAVPVLPHIPALAGKVLRFQKAFLTQLDELLTEHRMTWDPAQPPRDLTEAFLAKKEKAKGSPESSFNDENLRIVVGNLFLAGMVTTSTTLAWGLLLMILHLDVQLRVQQEIDDVIGQVRRPEMGDQAHMPCTTAVIHEVQRFGDIIPLSVTHMTSRDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 1212 - protein, 497 aa, Homo sapiens
  Payload ID: 375;
  Gene Symbol:;
  Gene Name: AC254788.1;
  ENSP ID: ENSP00000489366
MGLEALVPLAMIVAIFLLLVDLMHRHQRWAARYPPGPLPLPGLGNLLHVDFQNTPYCFDQLRRRFGDVFSLQLAWTPVVVLNGLAAVREAMVTRGEDTADRPPAPIYQVLGFGPRSQGVILSRYGPAWREQRRFSVSTLRNLGLGKKSLEQWVTEEAACLCAAFADQAGRPFRPNGLLDKAVSNVIASLTCGRRFEYDDPRFLRLLDLAQEGLKEESGFLREVLNAVPVLPHIPALAGKVLRFQKAFLTQLDELLTEHRMTWDPAQPPRDLTEAFLAKKEKAKGSPESSFNDENLRIVVGNLFLAGMVTTSTTLAWGLLLMILHLDVQLRVQQEIDDVIGQVRRPEMGDQAHMPCTTAVIHEVQRFGDIIPLSVTHMTSRDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 1213 - protein, 496 aa, Homo sapiens
  Payload ID: 375;
  Gene Symbol:;
  Gene Name: AC254788.1;
  ENSP ID: ENSP00000489470
MGLEALVPLAMIVAIFLLLVDLMHRHQRWAARYPPGPLPLPGLGNLHVDFQNTPYCFDQLRRRFGDVFSLQLAWTPVVVLNGLAAVREAMVTRGEDTADRPPAPIYQVLGFGPRSQGVILSRYGPAWREQRRFSVSTLRNLGLGKKSLEQWVTEEAACLCAAFADQAGRPFRPNGLLDKAVSNVIASLTCGRRFEYDDPRFLRLLDLAQEGLKEESGFLREVLNAVPVLPHIPALAGKVLRFQKAFLTQLDELLTEHRMTWDPAQPPRDLTEAFLAKKEKAKGSPESSFNDENLRIVVGNLFLAGMVTTSTTLAWGLLLMILHLDVQLRVQQEIDDVIGQVRRPEMGDQAHMPCTTAVIHEVQRFGDIIPLSVTHMTSRDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 1214 - protein, 497 aa, Homo sapiens; identical to SEQ ID NO: 1184
  Payload ID: 376;
  Gene Symbol:;
  Gene Name: AC254847.1;
  ENSP ID: ENSP00000488999

SEQ ID NO: 1215 - protein, 446 aa, Homo sapiens; identical to SEQ ID NO: 1185
  Payload ID: 376;
  Gene Symbol:;
  Gene Name: AC254847.1;
  ENSP ID: ENSP00000489410

SEQ ID NO: 1216 - protein, 267 aa, Homo sapiens; identical to SEQ ID NO: 1201
  Payload ID: 377;
  Gene Symbol:;
  Gene Name: AC254944.3;
  ENSP ID: ENSP00000488249

SEQ ID NO: 1217 - protein, 444 aa, Homo sapiens
  Payload ID: 378;
  Gene Symbol:;
  Gene Name: AC254995.1;
  ENSP ID: ENSP00000486942
MGLEALVPLAMIVAIFLLLVDLMHRHQRWAARYPPGPLPLPGLGNLHVDFQNTPYCFDQLRRRFGDVFSLQLAWTPVVVLNGLAAVREAMVTRGEDTADRPPAPIYQVLGFGPRSQGRPFRPNGLLDKAVSNVIASLTCGRRFEYDDPRFLRLLDLAQGSKEESGFLREVLNAVPVLPHIPALAGKVLRFQKAFLTQLDELLTEHRMTWDPAQPPRDLTEAFLAKKEKAKGSPESSFNDENLRIVVGNLFLAGMVTTLTTLAWGLLLMILHLDVQLRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 1218 - protein, 497 aa, Homo sapiens
  Payload ID: 378;
  Gene Symbol:;
  Gene Name: AC254995.1;
  ENSP ID: ENSP00000487070
MGLEALVPLAMIVAIFLLLVDLMHRHQRWAARYPPGPLPLPGLGNLLHVDFQNTPYCFDQLRRRFGDVFSLQLAWTPVVVLNGLAAVREAMVTRGEDTADRPPAPIYQVLGFGPRSQGVILSRYGPAWREQRRFSVSTLRNLGLGKKSLEQWVTEEAACLCAAFADQAGRPFRPNGLLDKAVSNVIASLTCGRRFEYDDPRFLRLLDLAQEGSKEESGFLREVLNAVPVLPHIPALAGKVLRFQKAFLTQLDELLTEHRMTWDPAQPPRDLTEAFLAKKEKAKGSPESSFNDENLRIVVGNLFLAGMVTTLTTLAWGLLLMILHLDVQLRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 1219 - protein, 672 aa, Homo sapiens
  Payload ID: 379;
  Gene Symbol: AACS;
  Gene Name: acetoacetyl-CoA synthetase;
  Uniprot ID:  Q86V21;
  ENSP ID: ENSP00000324842
MSKEERPGREEILECQVMWEPDSKKNTQMDRFRAAVGAACGLALESYDDLYHWSVESYSDFWAEFWKFSGIVFSRVYDEVVDTSKGIADVPEWFKGSRLNYAENLLRHKENDRVALYIAREGKEEIVKVTFEELRQEVALFAAAMRKMGVKKGDRVVGYLPNSEHAVEAMLAAASIGAIWSSTSPDFGVNGVLDRFSQIQPKLIFSVEAVVYNGKEHNHMEKLQQVVKGLPDLKKVVVIPYVSSRENIDLSKIPNSVFLDDFLATGTSEQAPQLEFEQLPFSHPLFIMFSSGTTGAPKCMVHSAGGTLIQHLKEHLLHGNMTSSDILLCYTTVGWMMWNWMVSLLATGAAMVLYDGSPLVPTPNVLWDLVDRIGITVLVTGAKWLSVLEEKAMKPVETHSLQMLHTILSTGSPLKAQSYEYVYRCIKSSILLGSISGGTDIISCFMGHNFSLPVYKGEIQARNLGMAVEAWNEEGKAVWGESGELVCTKPIPCQPTHFWNDENGNKYRKAYFSKFPGIWAHGDYCRINPKTGGIVMLGRSDGTLNPNGVRFGSSEIYNIVESFEEVEDSLCVPQYNKYREERVILFLKMASGHAFQPDLVKRIRDAIRMGLSARHVPSLILETKGIPYTLNGKKVEVAVKQIIAGKAVEQGGAFSNPETLDLYRDIPELQGF

SEQ ID NO: 1220 - protein, 218 aa, Homo sapiens
  Payload ID: 379;
  Gene Symbol: AACS;
  Gene Name: acetoacetyl-CoA synthetase;
  ENSP ID: ENSP00000416461
MSKEERPGREEILECQVMWEPDSKKNTQMDRFRAAVGAACGLALESYDDLYHWSVESYSDFWAEFWKFSGIVFSRVYDEVVDTSKGIADVPEWFKGSRLNYAENLLRHKENDRVALYIANQHKKPNHWKQAVSGPAQATEQGLPSAIVGRTSSPCAVGKDHGSPVPTETYWDTSSGAGAQASMYFQSPWALLMHIPGEEPWSNVSTYHMGLGKAKRKL

SEQ ID NO: 1221 - protein, 614 aa, Homo sapiens
  Payload ID: 380;
  Gene Symbol: ACHE;
  Gene Name: acetylcholinesterase (Yt blood group);
  Uniprot ID:  P22303;
  ENSP ID: ENSP00000241069
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 1222 - protein, 617 aa, Homo sapiens
  Payload ID: 380;
  Gene Symbol: ACHE;
  Gene Name: acetylcholinesterase (Yt blood group);
  Uniprot ID:  P22303;
  ENSP ID: ENSP00000303211
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATASEAPSTCPGFTHGEAAPRPGLPLPLLLLHQLLLLFLSHLRRL

SEQ ID NO: 1223 - protein, 403 aa, Homo sapiens
  Payload ID: 380;
  Gene Symbol: ACHE;
  Gene Name: acetylcholinesterase (Yt blood group);
  ENSP ID: ENSP00000390004
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQGSQ

SEQ ID NO: 1224 - protein, 614 aa, Homo sapiens; identical to SEQ ID NO: 1221
  Payload ID: 380;
  Gene Symbol: ACHE;
  Gene Name: acetylcholinesterase (Yt blood group);
  Uniprot ID:  P22303;
  ENSP ID: ENSP00000394976

SEQ ID NO: 1225 - protein, 158 aa, Homo sapiens
  Payload ID: 380;
  Gene Symbol: ACHE;
  Gene Name: acetylcholinesterase (Yt blood group);
  ENSP ID: ENSP00000396360
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGA

SEQ ID NO: 1226 - protein, 397 aa, Homo sapiens
  Payload ID: 380;
  Gene Symbol: ACHE;
  Gene Name: acetylcholinesterase (Yt blood group);
  ENSP ID: ENSP00000397143
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQTRSTRRSASGRPSSTAGAPTWCTGRTSSTTTASRIAAQTCD

SEQ ID NO: 1227 - protein, 434 aa, Homo sapiens
  Payload ID: 380;
  Gene Symbol: ACHE;
  Gene Name: acetylcholinesterase (Yt blood group);
  ENSP ID: ENSP00000399725
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGTRSTRRSASGRPSSTAGAPTWCTGRTSSTTTASRIAAQTCD

SEQ ID NO: 1228 - protein, 28 aa, Homo sapiens
  Payload ID: 380;
  Gene Symbol: ACHE;
  Gene Name: acetylcholinesterase (Yt blood group);
  ENSP ID: ENSP00000400933
MRPPQCLLHTPSLASPLLLLLLWLLGGG

SEQ ID NO: 1229 - protein, 526 aa, Homo sapiens
  Payload ID: 380;
  Gene Symbol: ACHE;
  Gene Name: acetylcholinesterase (Yt blood group);
  Uniprot ID:  P22303;
  ENSP ID: ENSP00000403474
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 1230 - protein, 617 aa, Homo sapiens; identical to SEQ ID NO: 1222
  Payload ID: 380;
  Gene Symbol: ACHE;
  Gene Name: acetylcholinesterase (Yt blood group);
  Uniprot ID:  P22303;
  ENSP ID: ENSP00000404865

SEQ ID NO: 1231 - protein, 359 aa, Homo sapiens
  Payload ID: 380;
  Gene Symbol: ACHE;
  Gene Name: acetylcholinesterase (Yt blood group);
  ENSP ID: ENSP00000410380
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQGSQ

SEQ ID NO: 1232 - protein, 614 aa, Homo sapiens; identical to SEQ ID NO: 1221
  Payload ID: 380;
  Gene Symbol: ACHE;
  Gene Name: acetylcholinesterase (Yt blood group);
  Uniprot ID:  P22303;
  ENSP ID: ENSP00000414858

SEQ ID NO: 1233 - protein, 55 aa, Homo sapiens
  Payload ID: 380;
  Gene Symbol: ACHE;
  Gene Name: acetylcholinesterase (Yt blood group);
  ENSP ID: ENSP00000415901
MRPPQCLLHTPSLASPLLLLLLWLLGGGVGAEGREDAELLVTVLRAPRCGTPTVS

SEQ ID NO: 1234 - protein, 427 aa, Homo sapiens
  Payload ID: 381;
  Gene Symbol: ACAT1;
  Gene Name: acetyl-CoA acetyltransferase 1;
  Uniprot ID:  P24752;
  ENSP ID: ENSP00000265838
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQDVMVAGGMESMSNVPYVMNRGSTPYGGVKLEDLIVKDGLTDVYNKIHMGSCAENTAKKLNIARNEQDAYAINSYTRSKAAWEAGKFGNEVIPVTVTVKGQPDVVVKEDEEYKRVDFSKVPKLKTVFQKENGTVTAANASTLNDGAAALVLMTADAAKRLNVTPLARIVAFADAAVEPIDFPIAPVYAASMVLKDVGLKKEDIAMWEVNEAFSLVVLANIKMLEIDPQKVNINGGAVSLGHPIGMSGARIVGHLTHALKQGEYGLASICNGGGGASAMLIQKL

SEQ ID NO: 1235 - protein, 162 aa, Homo sapiens
  Payload ID: 381;
  Gene Symbol: ACAT1;
  Gene Name: acetyl-CoA acetyltransferase 1;
  Uniprot ID:  P24752;
  ENSP ID: ENSP00000299355
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQIKQETGSLAKICCHVRR

SEQ ID NO: 1236 - protein, 54 aa, Homo sapiens
  Payload ID: 381;
  Gene Symbol: ACAT1;
  Gene Name: acetyl-CoA acetyltransferase 1;
  ENSP ID: ENSP00000433568
MGNVLQGGEGQAPTRQAVLGAGLPISTPCTTINKVCASGMKAIMMASQSLMCGH

SEQ ID NO: 1237 - protein, 141 aa, Homo sapiens
  Payload ID: 381;
  Gene Symbol: ACAT1;
  Gene Name: acetyl-CoA acetyltransferase 1;
  ENSP ID: ENSP00000435965
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGCDGGRWDGEHVQCSICNEQRINTIWWGKA

SEQ ID NO: 1238 - protein, 136 aa, Homo sapiens
  Payload ID: 381;
  Gene Symbol: ACAT1;
  Gene Name: acetyl-CoA acetyltransferase 1;
  ENSP ID: ENSP00000436096
  MOD_RES (1)..(1): Any amino acid
XKLGSIAIQGAIEKAGIPKEEVKEAYMGNVLQGGEGQAPTRQAVLGAGLPISTPCTTINKVCASGMKAIMMASQSLMCGHQDVMVAGGMESMSNVPYVMNRGSTPYGGVKLEDLIVKDGLTDVYNKIHMVNVIFSG

SEQ ID NO: 1239 - protein, 397 aa, Homo sapiens
  Payload ID: 382;
  Gene Symbol: ACAT2;
  Gene Name: acetyl-CoA acetyltransferase 2;
  Uniprot ID:  Q9BWD1;
  ENSP ID: ENSP00000356015
MNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRKGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 1240 - protein, 331 aa, Homo sapiens
  Payload ID: 383;
  Gene Symbol: ACAA1;
  Gene Name: acetyl-CoA acyltransferase 1;
  Uniprot ID:  P09110;
  ENSP ID: ENSP00000301810
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGITSENVAERFGISREKQDTFALASQQKAARAQSKGCFQAEIVPVTTTVHDDKGTKRSITVTQDEGIRPSTTMEGLAKLKPAFKKDGSTTAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 1241 - protein, 424 aa, Homo sapiens
  Payload ID: 383;
  Gene Symbol: ACAA1;
  Gene Name: acetyl-CoA acyltransferase 1;
  Uniprot ID:  P09110;
  ENSP ID: ENSP00000333664
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 1242 - protein, 121 aa, Homo sapiens
  Payload ID: 383;
  Gene Symbol: ACAA1;
  Gene Name: acetyl-CoA acyltransferase 1;
  ENSP ID: ENSP00000389226
MQRLQVVLGHLRGPADSGWMPQAAPCLSGAPQASAADVVVVHGRRTAICRAGRGGFKDTTPDELLSAVMTAVLKDVNLRPEQLGDICVDQHGVSYVFLFYIHTEMCCSLGPGQSWPESPSF

SEQ ID NO: 1243 - protein, 237 aa, Homo sapiens
  Payload ID: 383;
  Gene Symbol: ACAA1;
  Gene Name: acetyl-CoA acyltransferase 1;
  ENSP ID: ENSP00000391078
  MOD_RES (1)..(1): Any amino acid
XAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 1244 - protein, 383 aa, Homo sapiens
  Payload ID: 383;
  Gene Symbol: ACAA1;
  Gene Name: acetyl-CoA acyltransferase 1;
  ENSP ID: ENSP00000395183
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLRVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 1245 - protein, 113 aa, Homo sapiens
  Payload ID: 383;
  Gene Symbol: ACAA1;
  Gene Name: acetyl-CoA acyltransferase 1;
  ENSP ID: ENSP00000396485
MQRLQVVLGHLRGPADSGWMPQAAPCLSGAPQASAADVVVVHGRRTAICRAGRGGFKDTTPDELLSAVMTAVLKDVNLRPEQLGDICVVTSRRLCLCPLSIDSVRRGYRQWPA

SEQ ID NO: 1246 - protein, 290 aa, Homo sapiens
  Payload ID: 383;
  Gene Symbol: ACAA1;
  Gene Name: acetyl-CoA acyltransferase 1;
  ENSP ID: ENSP00000398172
  MOD_RES (1)..(1): Any amino acid
XRPEQLGDICVGNVLQPGAGAIMARIAQFLSDIPETVPLSTVNRQCSSGLQAVASIAGGIRNGSYDIGMACGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKR

SEQ ID NO: 1247 - protein, 113 aa, Homo sapiens; identical to SEQ ID NO: 1245
  Payload ID: 383;
  Gene Symbol: ACAA1;
  Gene Name: acetyl-CoA acyltransferase 1;
  ENSP ID: ENSP00000403124

SEQ ID NO: 1248 - protein, 121 aa, Homo sapiens; identical to SEQ ID NO: 1242
  Payload ID: 383;
  Gene Symbol: ACAA1;
  Gene Name: acetyl-CoA acyltransferase 1;
  ENSP ID: ENSP00000405785

SEQ ID NO: 1249 - protein, 153 aa, Homo sapiens
  Payload ID: 383;
  Gene Symbol: ACAA1;
  Gene Name: acetyl-CoA acyltransferase 1;
  ENSP ID: ENSP00000414021
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGWSPCPWLTEGTLEILLRA

SEQ ID NO: 1250 - protein, 113 aa, Homo sapiens; identical to SEQ ID NO: 1245
  Payload ID: 383;
  Gene Symbol: ACAA1;
  Gene Name: acetyl-CoA acyltransferase 1;
  ENSP ID: ENSP00000486456

SEQ ID NO: 1251 - protein, 121 aa, Homo sapiens; identical to SEQ ID NO: 1242
  Payload ID: 383;
  Gene Symbol: ACAA1;
  Gene Name: acetyl-CoA acyltransferase 1;
  ENSP ID: ENSP00000486920

SEQ ID NO: 1252 - protein, 397 aa, Homo sapiens
  Payload ID: 384;
  Gene Symbol: ACAA2;
  Gene Name: acetyl-CoA acyltransferase 2;
  Uniprot ID:  P42765;
  ENSP ID: ENSP00000285093
MALLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 1253 - protein, 124 aa, Homo sapiens
  Payload ID: 384;
  Gene Symbol: ACAA2;
  Gene Name: acetyl-CoA acyltransferase 2;
  ENSP ID: ENSP00000465045
MGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREEC

SEQ ID NO: 1254 - protein, 84 aa, Homo sapiens
  Payload ID: 384;
  Gene Symbol: ACAA2;
  Gene Name: acetyl-CoA acyltransferase 2;
  ENSP ID: ENSP00000465095
MGNVLQSSSDAIYLARHVGLRVGIPKETPALTINRLCGSGFQSIVNGCQEICVKEAEVVLCGGTESMSQAPYCVRNVRFGTKLG

SEQ ID NO: 1255 - protein, 394 aa, Homo sapiens
  Payload ID: 384;
  Gene Symbol: ACAA2;
  Gene Name: acetyl-CoA acyltransferase 2;
  ENSP ID: ENSP00000466015
MMGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 1256 - protein, 342 aa, Homo sapiens
  Payload ID: 384;
  Gene Symbol: ACAA2;
  Gene Name: acetyl-CoA acyltransferase 2;
  ENSP ID: ENSP00000466466
MGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 1257 - protein, 72 aa, Homo sapiens
  Payload ID: 384;
  Gene Symbol: ACAA2;
  Gene Name: acetyl-CoA acyltransferase 2;
  ENSP ID: ENSP00000468157
MGNVLQSSSDAIYLARHVGLRVGIPKETPALTINRLCGSGFQSIVNGCQEICVKEAEVVLCGGTESMSQAPY

SEQ ID NO: 1258 - protein, 120 aa, Homo sapiens
  Payload ID: 385;
  Gene Symbol: ACACA;
  Gene Name: acetyl-CoA carboxylase alpha;
  ENSP ID: ENSP00000477912
MDEPSPLAQPLELNQHSRFIIGSVSEDNSEDEISNLVKLDLLEEKEGSLSPASVGSDTLSDLGISSLQDGLALHIRSSMSGLHLVKQGRDRKKIDSQRDFTVASPAEFVTRFGGNKVIEK

SEQ ID NO: 1259 - protein, 2346 aa, Homo sapiens
  Payload ID: 385;
  Gene Symbol: ACACA;
  Gene Name: acetyl-CoA carboxylase alpha;
  Uniprot ID:  Q13085;
  ENSP ID: ENSP00000478547
MDEPSPLAQPLELNQHSRFIIGSVSEDNSEDEISNLVKLDLLEEKEGSLSPASVGSDTLSDLGISSLQDGLALHIRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 1260 - protein, 2383 aa, Homo sapiens
  Payload ID: 385;
  Gene Symbol: ACACA;
  Gene Name: acetyl-CoA carboxylase alpha;
  Uniprot ID:  Q13085;
  ENSP ID: ENSP00000478577
MWWSTLMSILRARSFWKWISTQTVRIIRAVRAHFGGIMDEPSPLAQPLELNQHSRFIIGSVSEDNSEDEISNLVKLDLLEEKEGSLSPASVGSDTLSDLGISSLQDGLALHIRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 1261 - protein, 114 aa, Homo sapiens
  Payload ID: 385;
  Gene Symbol: ACACA;
  Gene Name: acetyl-CoA carboxylase alpha;
  ENSP ID: ENSP00000478588
MWWSTLMSILRARSFWKWISTQTVRIIRAVRAHFGGIMDEPSPLAQPLELNQHSRFIIGSVSEDNSEDEISNLVKLDLLEEKEGSLSPASVGSDTLSDLGISSLQDGLALHIRL

SEQ ID NO: 1262 - protein, 42 aa, Homo sapiens
  Payload ID: 385;
  Gene Symbol: ACACA;
  Gene Name: acetyl-CoA carboxylase alpha;
  ENSP ID: ENSP00000479621
MSGLHLVKQGRDRKKIDSQRDFTVASPAEFVTRFGGNKVIEK

SEQ ID NO: 1263 - protein, 2288 aa, Homo sapiens
  Payload ID: 385;
  Gene Symbol: ACACA;
  Gene Name: acetyl-CoA carboxylase alpha;
  Uniprot ID:  Q13085;
  ENSP ID: ENSP00000479901
MEGSPEENKEMRYYMLQRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 1264 - protein, 2268 aa, Homo sapiens
  Payload ID: 385;
  Gene Symbol: ACACA;
  Gene Name: acetyl-CoA carboxylase alpha;
  Uniprot ID:  Q13085;
  ENSP ID: ENSP00000480031
MSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 1265 - protein, 52 aa, Homo sapiens
  Payload ID: 385;
  Gene Symbol: ACACA;
  Gene Name: acetyl-CoA carboxylase alpha;
  ENSP ID: ENSP00000480371
  MOD_RES (1)..(1): Any amino acid
XEIRHMFHVAWVDPEDPYKGYRYLYLTPQDYKRVSALNSVHCEHVEDEGESR

SEQ ID NO: 1266 - protein, 114 aa, Homo sapiens; identical to SEQ ID NO: 1261
  Payload ID: 385;
  Gene Symbol: ACACA;
  Gene Name: acetyl-CoA carboxylase alpha;
  ENSP ID: ENSP00000481900

SEQ ID NO: 1267 - protein, 96 aa, Homo sapiens
  Payload ID: 385;
  Gene Symbol: ACACA;
  Gene Name: acetyl-CoA carboxylase alpha;
  ENSP ID: ENSP00000482064
  MOD_RES (1)..(1): Any amino acid
XIKCISRDYVLKQIRSLVQANPEVAMDSIIHMTQHISPTQRAEVIRILSTMDSPSTLCMTSWDVRSQNPPPAHQSHLPHSVFITLARPSPPLPAQD

SEQ ID NO: 1268 - protein, 2288 aa, Homo sapiens; identical to SEQ ID NO: 1263
  Payload ID: 385;
  Gene Symbol: ACACA;
  Gene Name: acetyl-CoA carboxylase alpha;
  Uniprot ID:  Q13085;
  ENSP ID: ENSP00000482269

SEQ ID NO: 1269 - protein, 2268 aa, Homo sapiens; identical to SEQ ID NO: 1264
  Payload ID: 385;
  Gene Symbol: ACACA;
  Gene Name: acetyl-CoA carboxylase alpha;
  Uniprot ID:  Q13085;
  ENSP ID: ENSP00000482368

SEQ ID NO: 1270 - protein, 114 aa, Homo sapiens; identical to SEQ ID NO: 1261
  Payload ID: 385;
  Gene Symbol: ACACA;
  Gene Name: acetyl-CoA carboxylase alpha;
  ENSP ID: ENSP00000482498

SEQ ID NO: 1271 - protein, 2383 aa, Homo sapiens; identical to SEQ ID NO: 1260
  Payload ID: 385;
  Gene Symbol: ACACA;
  Gene Name: acetyl-CoA carboxylase alpha;
  Uniprot ID:  Q13085;
  ENSP ID: ENSP00000483300

SEQ ID NO: 1272 - protein, 2346 aa, Homo sapiens; identical to SEQ ID NO: 1259
  Payload ID: 385;
  Gene Symbol: ACACA;
  Gene Name: acetyl-CoA carboxylase alpha;
  Uniprot ID:  Q13085;
  ENSP ID: ENSP00000483674

SEQ ID NO: 1273 - protein, 94 aa, Homo sapiens
  Payload ID: 385;
  Gene Symbol: ACACA;
  Gene Name: acetyl-CoA carboxylase alpha;
  ENSP ID: ENSP00000483696
MSGLHLVKQGRDRKKIDSQRDFTVASPAEFVTRFGGNKVIEKVLIANNGIAAVKCMRSIRRWSYEMFRNERAIRFVVMVTPEDLKANAEYIKMA

SEQ ID NO: 1274 - protein, 112 aa, Homo sapiens
  Payload ID: 385;
  Gene Symbol: ACACA;
  Gene Name: acetyl-CoA carboxylase alpha;
  ENSP ID: ENSP00000483852
MDEPSPLAQPLELNQHSRFIIGSVSEDNSEDEISNLVKLDLLEEKEGSLSPASVGSDTLSDLGISSLQDGLALHISSWIKRSGSVVLGSHCSSESPRGALGDKPHPQRFRFI

SEQ ID NO: 1275 - protein, 998 aa, Homo sapiens
  Payload ID: 385;
  Gene Symbol: ACACA;
  Gene Name: acetyl-CoA carboxylase alpha;
  ENSP ID: ENSP00000483969
EDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 1276 - protein, 84 aa, Homo sapiens
  Payload ID: 385;
  Gene Symbol: ACACA;
  Gene Name: acetyl-CoA carboxylase alpha;
  ENSP ID: ENSP00000484948
MDEPSPLAQPLELNQHSRFIIGSVSEDNSEDEISNLVKLDLLEEKEGSLSPASVGSDTLSDLGISSLQDGLALHISSWIKRSGS

SEQ ID NO: 1277 - protein, 120 aa, Homo sapiens; identical to SEQ ID NO: 1258
  Payload ID: 385;
  Gene Symbol: ACACA;
  Gene Name: acetyl-CoA carboxylase alpha;
  ENSP ID: ENSP00000487874

SEQ ID NO: 1278 - protein, 114 aa, Homo sapiens; identical to SEQ ID NO: 1261
  Payload ID: 385;
  Gene Symbol: ACACA;
  Gene Name: acetyl-CoA carboxylase alpha;
  ENSP ID: ENSP00000487997

SEQ ID NO: 1279 - protein, 94 aa, Homo sapiens; identical to SEQ ID NO: 1273
  Payload ID: 385;
  Gene Symbol: ACACA;
  Gene Name: acetyl-CoA carboxylase alpha;
  ENSP ID: ENSP00000488112

SEQ ID NO: 1280 - protein, 96 aa, Homo sapiens; identical to SEQ ID NO: 1267
  Payload ID: 385;
  Gene Symbol: ACACA;
  Gene Name: acetyl-CoA carboxylase alpha;
  ENSP ID: ENSP00000488139
  MOD_RES (1)..(1): Any amino acid

SEQ ID NO: 1281 - protein, 84 aa, Homo sapiens; identical to SEQ ID NO: 1276
  Payload ID: 385;
  Gene Symbol: ACACA;
  Gene Name: acetyl-CoA carboxylase alpha;
  ENSP ID: ENSP00000488145

SEQ ID NO: 1282 - protein, 42 aa, Homo sapiens; identical to SEQ ID NO: 1262
  Payload ID: 385;
  Gene Symbol: ACACA;
  Gene Name: acetyl-CoA carboxylase alpha;
  ENSP ID: ENSP00000488223

SEQ ID NO: 1283 - protein, 52 aa, Homo sapiens; identical to SEQ ID NO: 1265
  Payload ID: 385;
  Gene Symbol: ACACA;
  Gene Name: acetyl-CoA carboxylase alpha;
  ENSP ID: ENSP00000488724
  MOD_RES (1)..(1): Any amino acid

SEQ ID NO: 1284 - protein, 112 aa, Homo sapiens; identical to SEQ ID NO: 1274
  Payload ID: 385;
  Gene Symbol: ACACA;
  Gene Name: acetyl-CoA carboxylase alpha;
  ENSP ID: ENSP00000488774

SEQ ID NO: 1285 - protein, 998 aa, Homo sapiens; identical to SEQ ID NO: 1275
  Payload ID: 385;
  Gene Symbol: ACACA;
  Gene Name: acetyl-CoA carboxylase alpha;
  ENSP ID: ENSP00000488846

SEQ ID NO: 1286 - protein, 2458 aa, Homo sapiens
  Payload ID: 386;
  Gene Symbol: ACACB;
  Gene Name: acetyl-CoA carboxylase beta;
  Uniprot ID:  O00763;
  ENSP ID: ENSP00000341044
MVLLLCLSCLIFSCLTFSWLKIWGKMTDSKPITKSKSEANLIPSQEPFPASDNSGETPQRNGEGHTLPKTPSQAEPASHKGPKDAGRRRNSLPPSHQKPPRNPLSSSDAAPSPELQANGTGTQGLEATDTNGLSSSARPQGQQAGSPSKEDKKQANIKRQLMTNFILGSFDDYSSDEDSVAGSSRESTRKGSRASLGALSLEAYLTTGEAETRVPTMRPSMSGLHLVKRGREHKKLDLHRDFTVASPAEFVTRFGGDRVIEKVLIANNGIAAVKCMRSIRRWAYEMFRNERAIRFVVMVTPEDLKANAEYIKMADHYVPVPGGPNNNNYANVELIVDIAKRIPVQAVWAGWGHASENPKLPELLCKNGVAFLGPPSEAMWALGDKIASTVVAQTLQVPTLPWSGSGLTVEWTEDDLQQGKRISVPEDVYDKGCVKDVDEGLEAAERIGFPLMIKASEGGGGKGIRKAESAEDFPILFRQVQSEIPGSPIFLMKLAQHARHLEVQILADQYGNAVSLFGRDCSIQRRHQKIVEEAPATIAPLAIFEFMEQCAIRLAKTVGYVSAGTVEYLYSQDGSFHFLELNPRLQVEHPCTEMIADVNLPAAQLQIAMGVPLHRLKDIRLLYGESPWGVTPISFETPSNPPLARGHVIAARITSENPDEGFKPSSGTVQELNFRSSKNVWGYFSVAATGGLHEFADSQFGHCFSWGENREEAISNMVVALKELSIRGDFRTTVEYLINLLETESFQNNDIDTGWLDYLIAEKVQAEKPDIMLGVVCGALNVADAMFRTCMTDFLHSLERGQVLPADSLLNLVDVELIYGGVKYILKVARQSLTMFVLIMNGCHIEIDAHRLNDGGLLLSYNGNSYTTYMKEEVDSYRITIGNKTCVFEKENDPTVLRSPSAGKLTQYTVEDGGHVEAGSSYAEMEVMKMIMTLNVQERGRVKYIKRPGAVLEAGCVVARLELDDPSKVHPAEPFTGELPAQQTLPILGEKLHQVFHSVLENLTNVMSGFCLPEPVFSIKLKEWVQKLMMTLRHPSLPLLELQEIMTSVAGRIPAPVEKSVRRVMAQYASNITSVLCQFPSQQIATILDCHAATLQRKADREVFFINTQSIVQLVQRYRSGIRGYMKTVVLDLLRRYLRVEHHFQQAHYDKCVINLREQFKPDMSQVLDCIFSHAQVAKKNQLVIMLIDELCGPDPSLSDELISILNELTQLSKSEHCKVALRARQILIASHLPSYELRHNQVESIFLSAIDMYGHQFCPENLKKLILSETTIFDVLPTFFYHANKVVCMASLEVYVRRGYIAYELNSLQHRQLPDGTCVVEFQFMLPSSHPNRMTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAVKDFNREKLPLMIFANWRGFSGGMKDMYDQVLKFGAYIVDGLRQYKQPILIYIPPYAELRGGSWVVIDATINPLCIEMYADKESRGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 1287 - protein, 2458 aa, Homo sapiens; identical to SEQ ID NO: 1286
  Payload ID: 386;
  Gene Symbol: ACACB;
  Gene Name: acetyl-CoA carboxylase beta;
  Uniprot ID:  O00763;
  ENSP ID: ENSP00000367079

SEQ ID NO: 1288 - protein, 858 aa, Homo sapiens
  Payload ID: 386;
  Gene Symbol: ACACB;
  Gene Name: acetyl-CoA carboxylase beta;
  ENSP ID: ENSP00000367085
MTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAVKDFNREKLPLMIFANWRGFSGGMKGCLGTWRDVSWWKIRAMLPMHIGEGSV

SEQ ID NO: 1289 - protein, 859 aa, Homo sapiens
  Payload ID: 386;
  Gene Symbol: ACACB;
  Gene Name: acetyl-CoA carboxylase beta;
  ENSP ID: ENSP00000443281
  MOD_RES (1)..(1): Any amino acid
XMTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAVKDFNREKLPLMIFANWRGFSGGMKGCLGTWRDVSWWKIRAMLPMHIGEGSV

SEQ ID NO: 1290 - protein, 143 aa, Homo sapiens
  Payload ID: 386;
  Gene Symbol: ACACB;
  Gene Name: acetyl-CoA carboxylase beta;
  ENSP ID: ENSP00000443494
MTDSKPITKSKSEANLIPSQEPFPASDNSGETPQRNGEGHTLPKTPSQAEPASHKGPKDAGRRRNSLPPSHQKPPRNPLSSSDAAPSPELQANGTGTQGLEATDTNGLSSSARPQGQQAGSPSKEDKKQANIKRQLMTNFILG

SEQ ID NO: 1291 - protein, 155 aa, Homo sapiens
  Payload ID: 386;
  Gene Symbol: ACACB;
  Gene Name: acetyl-CoA carboxylase beta;
  ENSP ID: ENSP00000474680
MSPAKCKICFPDREVKPSMSGLHLVKRGREHKKLDLHRDFTVASPAEFVTRFGGDRVIEKVLIANNGIAAVKCMRSIRRWAYEMFRNERAIRFVVMVTPEDLKANAEYIKMADHYVPVPGGPNNNNYANVELIVDIAKRIPVQAVWAGWGHASEN

SEQ ID NO: 1292 - protein, 112 aa, Homo sapiens
  Payload ID: 386;
  Gene Symbol: ACACB;
  Gene Name: acetyl-CoA carboxylase beta;
  ENSP ID: ENSP00000478488
  MOD_RES (1)..(1): Any amino acid
XVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKIHDHGYHREG

SEQ ID NO: 1293 - protein, 345 aa, Homo sapiens
  Payload ID: 387;
  Gene Symbol: ASMT;
  Gene Name: acetylserotonin O- methyltransferase;
  Uniprot ID:  P46597;
  ENSP ID: ENSP00000370627
MGSSEDQAYRLLNDYANGFMVSQVLFAACELGVFDLLAEAPGPLDVAAVAAGVRASAHGTELLLDICVSLKLLKVETRGGKAFYRNTELSSDYLTTVSPTSQCSMLKYMGRTSYRCWGHLADAVREGRNQYLETFGVPAEELFTAIYRSEGERLQFMQALQEVWSVNGRSVLTAFDLSVFPLMCDLGGGAGALAKECMSLYPGCKITVFDIPEVVWTAKQHFSFQEEEQIDFQEGDFFKDPLPEADLYILARVLHDWADGKCSHLLERIYHTCKPGGGILVIESLLDEDRRGPLLTQLYSLNMLVQTEGQERTPTHYHMLLSSAGFRDFQFKKTGAIYDAILARK

SEQ ID NO: 1294 - protein, 298 aa, Homo sapiens
  Payload ID: 387;
  Gene Symbol: ASMT;
  Gene Name: acetylserotonin O- methyltransferase;
  Uniprot ID:  P46597;
  ENSP ID: ENSP00000370631
MGSSEDQAYRLLNDYANGFMVSQVLFAACELGVFDLLAEAPGPLDVAAVAAGVRASAHGTELLLDICVSLKLLKVETRGGKAFYRNTELSSDYLTTVSPTSQCSMLKYMGRTSYRCWGHLADAVREGRNQYLETFGVPAEELFTAIYRSEGERLQFMQALQEVWSVNGRSVLTAFDLSVFPLMCDLGGDFFKDPLPEADLYILARVLHDWADGKCSHLLERIYHTCKPGGGILVIESLLDEDRRGPLLTQLYSLNMLVQTEGQERTPTHYHMLLSSAGFRDFQFKKTGAIYDAILARK

SEQ ID NO: 1295 - protein, 373 aa, Homo sapiens
  Payload ID: 387;
  Gene Symbol: ASMT;
  Gene Name: acetylserotonin O- methyltransferase;
  Uniprot ID:  P46597;
  ENSP ID: ENSP00000370639
MGSSEDQAYRLLNDYANGFMVSQVLFAACELGVFDLLAEAPGPLDVAAVAAGVRASAHGTELLLDICVSLKLLKVETRGGKAFYRNTELSSDYLTTVSPTSQCSMLKYMGRTSYRCWGHLADAVREGRNQYLETFGVPAEELFTAIYRSEGERLQFMQALQEVWSVNGRSVLTAFDLSVFPLMCDLGGTWIKLETIILSKLSQGQKTKHRVFSLIGGAGALAKECMSLYPGCKITVFDIPEVVWTAKQHFSFQEEEQIDFQEGDFFKDPLPEADLYILARVLHDWADGKCSHLLERIYHTCKPGGGILVIESLLDEDRRGPLLTQLYSLNMLVQTEGQERTPTHYHMLLSSAGFRDFQFKKTGAIYDAILARK

SEQ ID NO: 1296 - protein, 124 aa, Homo sapiens
  Payload ID: 387;
  Gene Symbol: ASMT;
  Gene Name: acetylserotonin O- methyltransferase;
  ENSP ID: ENSP00000392053
DCRLTSVCLPCVPGDFFKDPLPEADLYILARVLHDWADGKCSHLLERIYHTCKPGGGILVIESLLDEDRRGPLLTQLYSLNMLVQTEGQERTPTHYHMLLSSAGFRDFQFKKTGAIYDAILARK

SEQ ID NO: 1297 - protein, 621 aa, Homo sapiens
  Payload ID: 388;
  Gene Symbol: ASMTL;
  Gene Name: acetylserotonin O-methyltransferase-like;
  Uniprot ID:  O95671;
  ENSP ID: ENSP00000370718
MVLCPVIGKLLHKRVVLASASPRRQEILSNAGLRFEVVPSKFKEKLDKASFATPYGYAMETAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESCKPGAGLLLVETLLDEEKRVAQRALMQSLNMLVQTEGKERSLGEYQCLLELHGFHQVQVVHLGGVLDAILATKVAP

SEQ ID NO: 1298 - protein, 605 aa, Homo sapiens
  Payload ID: 388;
  Gene Symbol: ASMTL;
  Gene Name: acetylserotonin O-methyltransferase-like;
  Uniprot ID:  O95671;
  ENSP ID: ENSP00000370734
MVLCPVIGKLLHKRVVLASASPRRQEILSNAGLRFEVVPSKFKEKLDKASFATPYGYAMETAKQKALEVANRLYQTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESCKPGAGLLLVETLLDEEKRVAQRALMQSLNMLVQTEGKERSLGEYQCLLELHGFHQVQVVHLGGVLDAILATKVAP

SEQ ID NO: 1299 - protein, 563 aa, Homo sapiens
  Payload ID: 388;
  Gene Symbol: ASMTL;
  Gene Name: acetylserotonin O-methyltransferase-like;
  Uniprot ID:  O95671;
  ENSP ID: ENSP00000446410
METAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESCKPGAGLLLVETLLDEEKRVAQRALMQSLNMLVQTEGKERSLGEYQCLLELHGFHQVQVVHLGGVLDAILATKVAP

SEQ ID NO: 1300 - protein, 236 aa, Homo sapiens
  Payload ID: 389;
  Gene Symbol: ASCL1;
  Gene Name: achaete-scute family bHLH transcription factor 1;
  Uniprot ID:  P50553;
  ENSP ID: ENSP00000266744
MESSAKMESGGAGQQPQPQPQQPFLPPAACFFATAAAAAAAAAAAAAQSAQQQQQQQQQQQQAPQLRPAADGQPSGGGHKSAPKQVKRQRSSSPELMRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 1301 - protein, 193 aa, Homo sapiens
  Payload ID: 390;
  Gene Symbol: ASCL2;
  Gene Name: achaete-scute family bHLH transcription factor 2;
  Uniprot ID:  Q99929;
  ENSP ID: ENSP00000332293
MDGGTLPRSAPPAPPVPVGCAARRRPASPELLRCSRRRRPATAETGGGAAAVARRNERERNRVKLVNLGFQALRQHVPHGGASKKLSKVETLRSAVEYIRALQRLLAEHDAVRNALAGGLRPQAVRPSAPRGPPGTTPVAASPSRASSSPGRGGSSEPGSPRSAYSSDDSGCEGALSPAERELLDFSSWLGGY

SEQ ID NO: 1302 - protein, 181 aa, Homo sapiens
  Payload ID: 391;
  Gene Symbol: ASCL3;
  Gene Name: achaete-scute family bHLH transcription factor 3;
  Uniprot ID:  Q9NQ33;
  ENSP ID: ENSP00000435770
MMDNRGNSSLPDKLPIFPDSARLPLTRSFYLEPMVTFHVHPEAPVSSPYSEELPRLPFPSDSLILGNYSEPCPFSFPMPYPNYRGCEYSYGPAFTRKRNERERQRVKCVNEGYAQLRHHLPEEYLEKRLSKVETLRAAIKYINYLQSLLYPDKAETKNNPGKVSSMIATTSHHADPMFRIV

SEQ ID NO: 1303 - protein, 173 aa, Homo sapiens
  Payload ID: 392;
  Gene Symbol: ASCL4;
  Gene Name: achaete-scute family bHLH transcription factor 4;
  Uniprot ID:  Q6XD76;
  ENSP ID: ENSP00000345420
MMETRKPAERLALPYSLRTAPLGVPGTLPGLPRRDPLRVALRLDAACWEWARSGCARGWQYLPVPLDSAFEPAFLRKRNERERQRVRCVNEGYARLRDHLPRELADKRLSKVETLRAAIDYIKHLQELLERQAWGLEGAAGAVPQRRAECNSDGESKASSAPSPSSEPEEGGS

SEQ ID NO: 1304 - protein, 206 aa, Homo sapiens
  Payload ID: 393;
  Gene Symbol: ASCL5;
  Gene Name: achaete-scute family bHLH transcription factor 5;
  Uniprot ID:  Q7RTU5;
  ENSP ID: ENSP00000469019
MNNNFCRALVDRRPLGPPSCMQLGVMPPPRQAPLPPAEPLGNVPFLLYPGPAEPPYYDAYAGVFPYVPFPGAFGVYEYPFEPAFIQKRNERERQRVKCVNEGYARLRGHLPGALAEKRLSKVETLRAAIRYIKYLQELLSSAPDGSTPPASRGLPGTGPCPAPPATPRPDRPGDGEARAPSSLVPESSESSCFSPSPFLESEESWH

SEQ ID NO: 1305 - protein, 206 aa, Homo sapiens; identical to SEQ ID NO: 1304
  Payload ID: 393;
  Gene Symbol: ASCL5;
  Gene Name: achaete-scute family bHLH transcription factor 5;
  ENSP ID: ENSP00000472681

SEQ ID NO: 1306 - protein, 546 aa, Homo sapiens [sequence omitted]

SEQ ID NO: 1307 - protein, 513 aa, Homo sapiens
  Payload ID: 394;
  Gene Symbol: AAAS;
  Gene Name: achalasia, adrenocortical insufficiency, alacrimia;
  Uniprot ID:  Q9NRG9;
  ENSP ID: ENSP00000377908
MCSLGLFPPPPPRGQVTLYEHNNELVTGSSYESPPPDFRGQWINLPVLQLTKDPLKTPGRLDHGTRTAFIHHREQVWKRCINIWRDVGLFGVLNEIANSEEEVFEWVKTASGWALALCRWASSLHGSLFPHLSLRSEDLIAEFAQVTNCTIVPSLKHRLQRNVASLAWKPLSASVLAVACQSCILIWTLDPTSLSTRPSSGCAQVLSHPGHTPVTSLAWAPSGGRLLSASPVDAAIRVWDVSTETCVPLPWFRGGGVTNLLWSPDGSKILATTPSAVFRVWEAQMWTCERWPTLSGRCQTGCWSPDGSRLLFTVLGEPLIYSLSFPERCGEGKGCVGGAKSATIVADLSETTIQTPDGEERLGGEAHSMVWDPSGERLAVLMKGKPRVQDGKPVILLFRTRNSPVFELLPCGIIQGEPGAQPQLITFHPSFNKGALLSVGWSTGRIAHIPLYFVNAQFPRFSPVLGRAQEPPAGGGGSIHDLPLFTETSPTSAPWDPLPGPPPVLPHSPHSHL

SEQ ID NO: 1308 - protein, 422 aa, Homo sapiens
  Payload ID: 394;
  Gene Symbol: AAAS;
  Gene Name: achalasia, adrenocortical insufficiency, alacrimia;
  ENSP ID: ENSP00000446885
MKLQTQKKRLRSEDLIAEFAQVTNWSSCCLRVFAWHPHTNKFAVALLDDSVRVYNASSTIVPSLKHRLQRNVASLAWKPLSASVLAVACQSCILIWTLDPTSLSTRPSSGCAQVLSHPGHTPVTSLAWAPSGGRLLSASPVDAAIRVWDVSTETCVPLPWFRGGGVTNLLWSPDGSKILATTPSAVFRVWEAQMWTCERWPTLSGRCQTGCWSPDGSRLLFTVLGEPLIYSLSFPERCGEGKGCVGGAKSATIVADLSETTIQTPDGEERLGGEAHSMVWDPSGERLAVLMKGKPRVQDGKPVILLFRTRNSPVFELLPCGIIQGEPGAQPQLITFHPSFNKGALLSVGWSTGRIAHIPLYFVNAQFPRFSPVLGRAQEPPAGGGGSIHDLPLFTETSPTSAPWDPLPGPPPVLPHSPHSHL

SEQ ID NO: 1309 - protein, 277 aa, Homo sapiens
  Payload ID: 394;
  Gene Symbol: AAAS;
  Gene Name: achalasia, adrenocortical insufficiency, alacrimia;
  ENSP ID: ENSP00000448020
MCSLGLFPPPPPRGQVTLYEHNNELVTGSSYESPPPDFRGQWINLPVLQLTKDPLKTPGRLDHGTRTAFIHHREQVWKRCINIWRDVGLFGVLNEIANSEEEVFEWVKTASGWALALCRWASSLHGSLFPHLSLRSEDLIAEFAQVTNCTIVPSLKHRLQRNVASLAWKPLSASVLAVACQSCILIWTLDPTSLSTRPSSGCAQVLSHPGHTPVTSLAWAPSGGRLLSASPVDAAIRVWDVSTETCVPLPWFRGGGVTNLLWSPDGSKILATTPSAV

SEQ ID NO: 1310 - protein, 358 aa, Homo sapiens
  Payload ID: 394;
  Gene Symbol: AAAS;
  Gene Name: achalasia, adrenocortical insufficiency, alacrimia;
  ENSP ID: ENSP00000457518
PHTNKFAVALLDDSVRVYNASSTIVPSLKHRLQRNVASLAWKPLSASVLAVACQSCILIWTLDPTSLSTRPSSGCAQVLSHPGHTPVTSLAWAPSGGRLLSASPVDAAIRVWDVSTETCVPLPWFRGGGVTNLLWSPDGSKILATTPSAVFRVWEAQMWTCERWPTLSGRCQTGCWSPDGSRLLFTVLGEPLIYSLSFPERCGEGKGCVGGAKSATIVADLSETTIQTPDGEERLGGEAHSMVWDPSGERLAVLMKGKPRVQDGKPVILLFRTRNSPVFELLPWAGPQAELPTSRCTLSMPSFHVLAQCLGGPRNPLLGVEALFMTCPSLLRHPQPLPLGTLSQGHHLFCPTPHIPTS

SEQ ID NO: 1311 - protein, 158 aa, Homo sapiens
  Payload ID: 395;
  Gene Symbol: ACP1;
  Gene Name: acid phosphatase 1, soluble;
  Uniprot ID:  P24666;
  ENSP ID: ENSP00000272065
MAEQATKSVLFVCLGNICRSPIAEAVFRKLVTDQNISENWRVDSAATSGYEIGNPPDYRGQSCMKRHGIPMSHVARQITKEDFATFDYILCMDESNLRDLNRKSNQVKTCKAKIELLGSYDPQKQLIIEDPYYGNDSDFETVYQQCVRCCRAFLEKAH

SEQ ID NO: 1312 - protein, 158 aa, Homo sapiens
  Payload ID: 395;
  Gene Symbol: ACP1;
  Gene Name: acid phosphatase 1, soluble;
  Uniprot ID:  P24666;
  ENSP ID: ENSP00000272067
MAEQATKSVLFVCLGNICRSPIAEAVFRKLVTDQNISENWVIDSGAVSDWNVGRSPDPRAVSCLRNHGIHTAHKARQITKEDFATFDYILCMDESNLRDLNRKSNQVKTCKAKIELLGSYDPQKQLIIEDPYYGNDSDFETVYQQCVRCCRAFLEKAH

SEQ ID NO: 1313 - protein, 46 aa, Homo sapiens
  Payload ID: 395;
  Gene Symbol: ACP1;
  Gene Name: acid phosphatase 1, soluble;
  ENSP ID: ENSP00000384184
MAEQATKSVLFVCLGKIFYCCGNYSLCGKKVTFVDHPLQKQFSGNL

SEQ ID NO: 1314 - protein, 70 aa, Homo sapiens
  Payload ID: 395;
  Gene Symbol: ACP1;
  Gene Name: acid phosphatase 1, soluble;
  ENSP ID: ENSP00000384307
MAEQATKSVLFVCLGNICRSPIAEAVFRKLVTDQNISENWRVDSAATSGGSLTAVLFLTGTWAGPQTQEL

SEQ ID NO: 1315 - protein, 112 aa, Homo sapiens
  Payload ID: 395;
  Gene Symbol: ACP1;
  Gene Name: acid phosphatase 1, soluble;
  Uniprot ID:  P24666;
  ENSP ID: ENSP00000385404
MAEQATKSVLFVCLGNICRSPIAEAVFRKLVTDQNISENWRVDSAATSGYEIGNPPDYRGQSCMKRHGIPMSHVARQVPSLDLKLCVLCFSGSLTAVLFLTGTWAGPQTQEL

SEQ ID NO: 1316 - protein, 46 aa, Homo sapiens; identical to SEQ ID NO: 1313
  Payload ID: 395;
  Gene Symbol: ACP1;
  Gene Name: acid phosphatase 1, soluble;
  ENSP ID: ENSP00000389681

SEQ ID NO: 1317 - protein, 85 aa, Homo sapiens
  Payload ID: 395;
  Gene Symbol: ACP1;
  Gene Name: acid phosphatase 1, soluble;
  ENSP ID: ENSP00000408596
MAEQATKSVLFVCLGNICRSPIAEAVFRKLVTDQNISENWVIDSGAVSDWNVGRSPDPRAVSCLRNHGIHTAHKARQVDKLLFNF

SEQ ID NO: 1318 - protein, 80 aa, Homo sapiens
  Payload ID: 395;
  Gene Symbol: ACP1;
  Gene Name: acid phosphatase 1, soluble;
  ENSP ID: ENSP00000410331
MAEQATKSVLFVCLGNICRSPIAEAVFRKLVTDQNISENWRVDSAATSGYEIGNPPDYRGQSCMKRHGIPMSHVARQRFE

SEQ ID NO: 1319 - protein, 70 aa, Homo sapiens; identical to SEQ ID NO: 1314
  Payload ID: 395;
  Gene Symbol: ACP1;
  Gene Name: acid phosphatase 1, soluble;
  ENSP ID: ENSP00000411121

SEQ ID NO: 1320 - protein, 423 aa, Homo sapiens
  Payload ID: 396;
  Gene Symbol: ACP2;
  Gene Name: acid phosphatase 2, lysosomal;
  Uniprot ID:  P11117;
  ENSP ID: ENSP00000256997
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 1321 - protein, 391 aa, Homo sapiens
  Payload ID: 396;
  Gene Symbol: ACP2;
  Gene Name: acid phosphatase 2, lysosomal;
  ENSP ID: ENSP00000432205
MAGKRSGWSRAALLQLLLGVNLVVMPPTRARSLRFVTLEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 1322 - protein, 395 aa, Homo sapiens
  Payload ID: 396;
  Gene Symbol: ACP2;
  Gene Name: acid phosphatase 2, lysosomal;
  ENSP ID: ENSP00000432439
MGVRMTEYVGLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 1323 - protein, 160 aa, Homo sapiens
  Payload ID: 396;
  Gene Symbol: ACP2;
  Gene Name: acid phosphatase 2, lysosomal;
  ENSP ID: ENSP00000432466
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRSRTETLIHFS

SEQ ID NO: 1324 - protein, 162 aa, Homo sapiens
  Payload ID: 396;
  Gene Symbol: ACP2;
  Gene Name: acid phosphatase 2, lysosomal;
  ENSP ID: ENSP00000434205
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRQAQVTRTVEHSA

SEQ ID NO: 1325 - protein, 151 aa, Homo sapiens
  Payload ID: 396;
  Gene Symbol: ACP2;
  Gene Name: acid phosphatase 2, lysosomal;
  ENSP ID: ENSP00000435261
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRD

SEQ ID NO: 1326 - protein, 305 aa, Homo sapiens
  Payload ID: 396;
  Gene Symbol: ACP2;
  Gene Name: acid phosphatase 2, lysosomal;
  ENSP ID: ENSP00000436487
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPW

SEQ ID NO: 1327 - protein, 360 aa, Homo sapiens
  Payload ID: 396;
  Gene Symbol: ACP2;
  Gene Name: acid phosphatase 2, lysosomal;
  ENSP ID: ENSP00000436658
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 1328 - protein, 325 aa, Homo sapiens
  Payload ID: 397;
  Gene Symbol: ACP5;
  Gene Name: acid phosphatase 5, tartrate resistant;
  Uniprot ID:  P13686;
  ENSP ID: ENSP00000218758
MDMWTALLILQALLLPSLADGATPALRFVAVGDWGGVPNAPFHTAREMANAKEIARTVQILGADFILSLGDNFYFTGVQDINDKRFQETFEDVFSDRSLRKVPWYVLAGNHDHLGNVSAQIAYSKISKRWNFPSPFYRLHFKIPQTNVSVAIFMLDTVTLCGNSDDFLSQQPERPRDVKLARTQLSWLKKQLAAAREDYVLVAGHYPVWSIAEHGPTHCLVKQLRPLLATYGVTAYLCGHDHNLQYLQDENGVGYVLSGAGNFMDPSKRHQRKVPNGYLRFHYGTEDSLGGFAYVEISSKEMTVTYIEASGKSLFKTRLPRRARP

SEQ ID NO: 1329 - protein, 325 aa, Homo sapiens; identical to SEQ ID NO: 1328
  Payload ID: 397;
  Gene Symbol: ACP5;
  Gene Name: acid phosphatase 5, tartrate resistant;
  Uniprot ID:  P13686;
  ENSP ID: ENSP00000392374

SEQ ID NO: 1330 - protein, 325 aa, Homo sapiens; identical to SEQ ID NO: 1328
  Payload ID: 397;
  Gene Symbol: ACP5;
  Gene Name: acid phosphatase 5, tartrate resistant;
  Uniprot ID:  P13686;
  ENSP ID: ENSP00000413456

SEQ ID NO: 1331 - protein, 52 aa, Homo sapiens
  Payload ID: 397;
  Gene Symbol: ACP5;
  Gene Name: acid phosphatase 5, tartrate resistant;
  ENSP ID: ENSP00000464831
MDMWTALLILQALLLPSLADGATPALRFVAVGDWGGVPNAPFHTAREMANAK

SEQ ID NO: 1332 - protein, 124 aa, Homo sapiens
  Payload ID: 397;
  Gene Symbol: ACP5;
  Gene Name: acid phosphatase 5, tartrate resistant;
  ENSP ID: ENSP00000465127
MDMWTALLILQALLLPSLADGATPALRFVAVGDWGGVPNAPFHTAREMANAKEIARTVQILGADFILSLGDNFYFTGVQDINDKRFQETFEDVFSDRSLRKVPWYVLAGNHDHLGNVSAQIAYS

SEQ ID NO: 1333 - protein, 5 aa, Homo sapiens
  Payload ID: 397;
  Gene Symbol: ACP5;
  Gene Name: acid phosphatase 5, tartrate resistant;
  ENSP ID: ENSP00000465498
MDMWT

SEQ ID NO: 1334 - protein, 59 aa, Homo sapiens
  Payload ID: 397;
  Gene Symbol: ACP5;
  Gene Name: acid phosphatase 5, tartrate resistant;
  ENSP ID: ENSP00000468509
MDMWTALLILQALLLPSLGISWTPQSGTSARSPTAICASTMGLKTHWVALPMWRSAPKR

SEQ ID NO: 1335 - protein, 74 aa, Homo sapiens
  Payload ID: 397;
  Gene Symbol: ACP5;
  Gene Name: acid phosphatase 5, tartrate resistant;
  ENSP ID: ENSP00000468685
MDMWTALLILQALLLPSLADGATPALRFVAVGDWGGVPNAPFHTAREMANAKEIARTVQILGADFILSLGDNFY

SEQ ID NO: 1336 - protein, 325 aa, Homo sapiens; identical to SEQ ID NO: 1328
  Payload ID: 397;
  Gene Symbol: ACP5;
  Gene Name: acid phosphatase 5, tartrate resistant;
  Uniprot ID:  P13686;
  ENSP ID: ENSP00000468767

SEQ ID NO: 1337 - protein, 228 aa, Homo sapiens
  Payload ID: 398;
  Gene Symbol: ACP6;
  Gene Name: acid phosphatase 6, lysophosphatidic;
  ENSP ID: ENSP00000376714
MITGVFSMRLWTPVGVLTSLAYCLHQRRVALAELQEADGQCPVDRSLLKLKMVQVVFRHGARSPLKPLPLEEQGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQEKMGSCRFHGS

SEQ ID NO: 1338 - protein, 428 aa, Homo sapiens
  Payload ID: 398;
  Gene Symbol: ACP6;
  Gene Name: acid phosphatase 6, lysophosphatidic;
  ENSP ID: ENSP00000463574
MITGVFSMRLWTPVGVLTSLAYCLHQRRVALAELQEADGQCPVDRSLLKLKMVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQAHNLPSCPMLKRFARMIEQRAVDTSLYILPKEDRESLQMAVGPFLHILESNLLKAMDSATAPDKIRKLYLYAAHDVTFIPLLMTLGIFDHKWPPFAVDLTMELYQHLESKEWFVQLYYHGKEQVPRGCPDGLCPLDMFLNAMSVYTLSPEKYHALCSQTQVMEVGNEE

SEQ ID NO: 1339 - protein, 157 aa, Homo sapiens
  Payload ID: 398;
  Gene Symbol: ACP6;
  Gene Name: acid phosphatase 6, lysophosphatidic;
  ENSP ID: ENSP00000477476
  MOD_RES (1)..(1): Any amino acid
XRCLLAGLFQCQKEGPIIIHTDEADSEVLYPNYQSCWSLRQRTRGRRQTASLQPGISEDLKKVKDRMGIDSSDKVDFFILLDNVAAEQAHNLPSCPMLKRFARMIEQRAVDTSLYILPKEDRESLQMAVGPFLHILESNLLKAMDSATAPDKIRTCR

SEQ ID NO: 1340 - protein, 143 aa, Homo sapiens
  Payload ID: 398;
  Gene Symbol: ACP6;
  Gene Name: acid phosphatase 6, lysophosphatidic;
  ENSP ID: ENSP00000479906
MVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTD

SEQ ID NO: 1341 - protein, 77 aa, Homo sapiens
  Payload ID: 398;
  Gene Symbol: ACP6;
  Gene Name: acid phosphatase 6, lysophosphatidic;
  ENSP ID: ENSP00000480100
MITGVFSMRLWTPVGVLTSLAYCLHQRRVALAELQEADGQCPVDRSLLKLKMVQVVFRHGARSPLKPLPLEEQYSFH

SEQ ID NO: 1342 - protein, 271 aa, Homo sapiens
  Payload ID: 398;
  Gene Symbol: ACP6;
  Gene Name: acid phosphatase 6, lysophosphatidic;
  Uniprot ID:  Q9NPH0;
  ENSP ID: ENSP00000481777
MITGVFSMRLWTPVGVLTSLAYCLHQRRVALAELQEADGQCPVDRSLLKLKMVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQEKMGSCRFHGS

SEQ ID NO: 1343 - protein, 166 aa, Homo sapiens
  Payload ID: 398;
  Gene Symbol: ACP6;
  Gene Name: acid phosphatase 6, lysophosphatidic;
  ENSP ID: ENSP00000482100
  MOD_RES (1)..(1): Any amino acid
XDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQEKMGSCRFHGS

SEQ ID NO: 1344 - protein, 418 aa, Homo sapiens
  Payload ID: 399;
  Gene Symbol: ACPP;
  Gene Name: acid phosphatase, prostate;
  Uniprot ID:  P15309;
  ENSP ID: ENSP00000323036
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQVLKVIFAVAFCLISAVLMVLLFIHIRRGLCWQRESYGNI

SEQ ID NO: 1345 - protein, 386 aa, Homo sapiens
  Payload ID: 399;
  Gene Symbol: ACPP;
  Gene Name: acid phosphatase, prostate;
  Uniprot ID:  P15309;
  ENSP ID: ENSP00000337471
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQGTEDSTD

SEQ ID NO: 1346 - protein, 353 aa, Homo sapiens
  Payload ID: 399;
  Gene Symbol: ACPP;
  Gene Name: acid phosphatase, prostate;
  Uniprot ID:  P15309;
  ENSP ID: ENSP00000417744
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQGTEDSTD

SEQ ID NO: 1347 - protein, 165 aa, Homo sapiens
  Payload ID: 399;
  Gene Symbol: ACPP;
  Gene Name: acid phosphatase, prostate;
  ENSP ID: ENSP00000418366
MRAAPLLLARAASLSLGFLFLLFFWLDRSVLAKELKFVTLVFRHGDRSPIDTFPTDPIKESSWPQGFGQLTQVYIRSTDVDRTLMSAMTNLAALFPPEGVSIWNPILLWQPIPVHTVPLSEDQLLYLPFRNCPRFQELESETLKSEEFQKRLHPYKDFIATLGKL

SEQ ID NO: 1348 - protein, 99 aa, Homo sapiens
  Payload ID: 399;
  Gene Symbol: ACPP;
  Gene Name: acid phosphatase, prostate;
  ENSP ID: ENSP00000422036
  MOD_RES (1)..(1): Any amino acid
XELYFEKGEYFVEMYYRNETQHEPYPLMLPGCSPSCPLERFAELVGPVIPQDWSTECMTTNSHQGPAETAHSARRNHDIALPCGRSTCLENTVLYYHYG

SEQ ID NO: 1349 - protein, 426 aa, Homo sapiens
  Payload ID: 400;
  Gene Symbol: ACPT;
  Gene Name: acid phosphatase, testicular;
  Uniprot ID:  Q9BZG2;
  ENSP ID: ENSP00000270593
MAGLGFWGHPAGPLLLLLLLVLPPRALPEGPLVFVALVFRHGDRAPLASYPMDPHKEVASTLWPRGLGQLTTEGVRQQLELGRFLRSRYEAFLSPEYRREEVYIRSTDFDRTLESAQANLAGLFPEAAPGSPEARWRPIPVHTVPVAEDKLLRFPMRSCPRYHELLREATEAAEYQEALEGWTGFLSRLENFTGLSLVGEPLRRAWKVLDTLMCQQAHGLPLPAWASPDVLRTLAQISALDIGAHVGPPRAAEKAQLTGGILLNAILANFSRVQRLGLPLKMVMYSAHDSTLLALQGALGLYDGHTPPYAACLGFEFRKHLGNPAKDGGNVTVSLFYRNDSAHLPLPLSLPGCPAPCPLGRFYQLTAPARPPAHGVSCHGPYEAAIPPAPVVPLLAGAVAVLVALSLGLGLLAWRPGCLRALGGPV

SEQ ID NO: 1350 - protein, 574 aa, Homo sapiens
  Payload ID: 401;
  Gene Symbol: ASIC1;
  Gene Name: acid sensing (proton gated) ion channel 1;
  Uniprot ID:  P78348;
  ENSP ID: ENSP00000228468
MELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGELLMTPVPFSCHGHGVAPYHPKAGCSLLSHEGPPPQRPFPKPCCLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 1351 - protein, 528 aa, Homo sapiens
  Payload ID: 401;
  Gene Symbol: ASIC1;
  Gene Name: acid sensing (proton gated) ion channel 1;
  Uniprot ID:  P78348;
  ENSP ID: ENSP00000400228
MELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 1352 - protein, 396 aa, Homo sapiens
  Payload ID: 401;
  Gene Symbol: ASIC1;
  Gene Name: acid sensing (proton gated) ion channel 1;
  ENSP ID: ENSP00000402896
  MOD_RES (1)..(1): Any amino acid
XIRDMLLSCHFRGEVCSAEDFKVKPMQVAKELRRCTLPGTVFQGTQRARKGEKQVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 1353 - protein, 127 aa, Homo sapiens
  Payload ID: 401;
  Gene Symbol: ASIC1;
  Gene Name: acid sensing (proton gated) ion channel 1;
  ENSP ID: ENSP00000446863
  MOD_RES (1)..(1): Any amino acid
XENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 1354 - protein, 263 aa, Homo sapiens
  Payload ID: 401;
  Gene Symbol: ASIC1;
  Gene Name: acid sensing (proton gated) ion channel 1;
  ENSP ID: ENSP00000448263
MELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVKPMQVAKELRRCTLPGTVFQGTQRARKGLHTLWKVLHVQLGPRWAAAAEDHEGWDGQWAGNHAGHPAGRVPACVGGD

SEQ ID NO: 1355 - protein, 562 aa, Homo sapiens
  Payload ID: 401;
  Gene Symbol: ASIC1;
  Gene Name: acid sensing (proton gated) ion channel 1;
  Uniprot ID:  P78348;
  ENSP ID: ENSP00000450247
MPIQIFCSMSFSSGEEAPGPLGDIWGPHHHQQQQDISESEEEEEEKEKEAVRKEASEGHSPMDLVAFANSCTLHGTNHIFVEGGPGPRQVLWAVAFVLALGAFLCQVGDRVAYYLSYPHVTLLNEVATTELAFPAVTLCNTNAVRLSQLSYPDLLYLAPMLGLDESDDPGVPLAPPGPEAFSGEPFNLHRFYNRSCHRLEDMLLYCSYQGGPCGPHNFSVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 1356 - protein, 563 aa, Homo sapiens
  Payload ID: 402;
  Gene Symbol: ASIC2;
  Gene Name: acid sensing (proton gated) ion channel 2;
  Uniprot ID:  Q16515;
  ENSP ID: ENSP00000225823
MSRIGGAGLPAAALTGPGRFRMAREEPAPAALAAAGQPGGGRGGERALQGPGVARRGRPSLSRAKLHGLRHMCAGRTAAGGSFQRRALWVLAFCTSFGLLLSWSSNRLLYWLSFPSHTRVHREWSRQLPFPAVTVCNNNPLRFPRLSKGDLYYAGHWLGLLLPNRTARPLVSELLRGDEPRRQWFRKLADFRLFLPPRHFEGISAAFMDRLGHQLEDMLLSCKYRGELCGPHNFSSVFTKYGKCYMFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENILVLDIFFEALNYETIEQKKAYEVAALLGDIGGQMGLFIGASILTILELFDYIYELIKEKLLDLLGKEEDEGSHDENVSTCDTMPNHSETISHTVNVPLQTTLGTLEEIAC

SEQ ID NO: 1357 - protein, 512 aa, Homo sapiens
  Payload ID: 402;
  Gene Symbol: ASIC2;
  Gene Name: acid sensing (proton gated) ion channel 2;
  Uniprot ID:  Q16515;
  ENSP ID: ENSP00000352934
MDLKESPSEGSLQPSSIQIFANTSTLHGIRHIFVYGPLTIRRVLWAVAFVGSLGLLLVESSERVSYYFSYQHVTKVDEVVAQSLVFPAVTLCNLNGFRFSRLTTNDLYHAGELLALLDVNLQIPDPHLADPSVLEALRQKANFKHYKPKQFSMLEFLHRVGHDLKDMMLYCKFKGQECGHQDFTTVFTKYGKCYMFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENILVLDIFFEALNYETIEQKKAYEVAALLGDIGGQMGLFIGASILTILELFDYIYELIKEKLLDLLGKEEDEGSHDENVSTCDTMPNHSETISHTVNVPLQTTLGTLEEIAC

SEQ ID NO: 1358 - protein, 549 aa, Homo sapiens
  Payload ID: 403;
  Gene Symbol: ASIC3;
  Gene Name: acid sensing (proton gated) ion channel 3;
  Uniprot ID:  Q9UHC3;
  ENSP ID: ENSP00000297512
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQLSFLPPPWGDCSSASLNPNYEPEPSDPLGSPSPSPSPPYTLMGCRLACETRYVARKCGCRMVYMPGDVPVCSPQQYKNCAHPAIDAMLRKDSCACPNPCASTRYAKELSMVRIPSRAAARFLARKLNRSEAYIAENVLALDIFFEALNYETVEQKKAYEMSELLGDIGGQMGLFIGASLLTILEILDYLCEVFRDKVLGYFWNRQHSQRHSSTNLLQEGLGSHRTQVPHLSLGPSTLLCSEDLPPLPVPSPRLSPPPTAPATLSHSSRPAVCVLGAPP

SEQ ID NO: 1359 - protein, 531 aa, Homo sapiens
  Payload ID: 403;
  Gene Symbol: ASIC3;
  Gene Name: acid sensing (proton gated) ion channel 3;
  Uniprot ID:  Q9UHC3;
  ENSP ID: ENSP00000344838
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQLSFLPPPWGDCSSASLNPNYEPEPSDPLGSPSPSPSPPYTLMGCRLACETRYVARKCGCRMVYMPGDVPVCSPQQYKNCAHPAIDAMLRKDSCACPNPCASTRYAKELSMVRIPSRAAARFLARKLNRSEAYIAENVLALDIFFEALNYETVEQKKAYEMSELLGDIGGQMGLFIGASLLTILEILDYLCEVFRDKVLGYFWNRQHSQRHSSTNLLQEGLGSHRTQVPHLSLGPRPPTPPCAVTKTLSASHRTCYLVTQL

SEQ ID NO: 1360 - protein, 543 aa, Homo sapiens
  Payload ID: 403;
  Gene Symbol: ASIC3;
  Gene Name: acid sensing (proton gated) ion channel 3;
  Uniprot ID:  Q9UHC3;
  ENSP ID: ENSP00000350600
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQLSFLPPPWGDCSSASLNPNYEPEPSDPLGSPSPSPSPPYTLMGCRLACETRYVARKCGCRMVYMPGDVPVCSPQQYKNCAHPAIDAMLRKDSCACPNPCASTRYAKELSMVRIPSRAAARFLARKLNRSEAYIAENVLALDIFFEALNYETVEQKKAYEMSELLGDIGGQMGLFIGASLLTILEILDYLCEVFRDKVLGYFWNRQHSQRHSSTNLTSHPSLCRHQDSLRLPPHLLPCHTALDLLSVSSEPRPDILDMPSLHVAFPSSPQIKS

SEQ ID NO: 1361 - protein, 407 aa, Homo sapiens
  Payload ID: 403;
  Gene Symbol: ASIC3;
  Gene Name: acid sensing (proton gated) ion channel 3;
  Uniprot ID:  Q9UHC3;
  ENSP ID: ENSP00000367136
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQLSFLPPPWGDCSSASLNPNYEPEPSDPLGSPSPSPSPPYTLMGCRLACETRYVARKCGCRMVYMPGDVPVCSPQQYKNCAHPAIGRTCWPWTSSLRPSTMRPWSRRRPMRCQSCLVTLGARWGCSSGPACSPSSRS

SEQ ID NO: 1362 - protein, 149 aa, Homo sapiens
  Payload ID: 403;
  Gene Symbol: ASIC3;
  Gene Name: acid sensing (proton gated) ion channel 3;
  ENSP ID: ENSP00000418361
CASTRYAKELSMVRIPSRAAARFLARKLNRSEAYIAENVLALDIFFEALNYETVEQKKAYEMSELLGDIGGQMGLFIGASLLTILEILDYLCEVFRDKVLGYFWNRQHSQRHSSTNLLQEGLGSHRTQVPHLSLGPSSRPAVCVLGAPP

SEQ ID NO: 1363 - protein, 407 aa, Homo sapiens; identical to SEQ ID NO: 1361
  Payload ID: 403;
  Gene Symbol: ASIC3;
  Gene Name: acid sensing (proton gated) ion channel 3;
  Uniprot ID:  Q9UHC3;
  ENSP ID: ENSP00000418605

SEQ ID NO: 1364 - protein, 144 aa, Homo sapiens
  Payload ID: 403;
  Gene Symbol: ASIC3;
  Gene Name: acid sensing (proton gated) ion channel 3;
  ENSP ID: ENSP00000420371
  MOD_RES (1)..(1): Any amino acid
XEVRLPNGVHARRRASVQPPAVQELCPPGHRENVLALDIFFEALNYETVEQKKAYEMSELLGDIGGQMGLFIGASLLTILEILDYLCEVFRDKVLGYFWNRQHSQRHSSTNLLQEGLGSHRTQVPHLSLGPSSRPAVCVLGAPP

SEQ ID NO: 1365 - protein, 647 aa, Homo sapiens
  Payload ID: 404;
  Gene Symbol: ASIC4;
  Gene Name: acid sensing (proton gated) ion channel family member 4;
  Uniprot ID:  Q96FT7;
  ENSP ID: ENSP00000326627
MLSGAAGAARRGGAALAPSLTRSLAGTHAGADSCAGADKGSHKETIEERDKRQQRQQRQRQHQGCGAAGSGSDSPTSGPHPVPVLFPLALSLEEQPLPPLPLGRAPGLLAREGQGREALASPSSRGQMPIEIVCKIKFAEEDAKPKEKEAGDEQSLLGAVAPGAAPRDLATFASTSTLHGLGRACGPGPHGLRRTLWALALLTSLAAFLYQAAGLARGYLTRPHLVAMDPAAPAPVAGFPAVTLCNINRFRHSALSDADIFHLANLTGLPPKDRDGHRAAGLRYPEPDMVDILNRTGHQLADMLKSCNFSGHHCSASNFSVVYTRYGKCYTFNADPRSSLPSRAGGMGSGLEIMLDIQQEEYLPIWRETNETSFEAGIRVQIHSQEEPPYIHQLGFGVSPGFQTFVSCQEQRLTYLPQPWGNCRAESELREPELQGYSAYSVSACRLRCEKEAVLQRCHCRMVHMPDSLGGGPEGPCFCPTPCNLTRYGKEISMVRIPNRGSARYLARKYNRNETYIRENFLVLDVFFEALTSEAMEQRAAYGLSALLGDLGGQMGLFIGASILTLLEILDYIYEVSWDRLKRVWRRPKTPLRTSTGGISTLGLQELKEQSPCPSRGRVEGGGVSSLLPNHHHPHGPPGGLFEDFAC

SEQ ID NO: 1366 - protein, 666 aa, Homo sapiens
  Payload ID: 404;
  Gene Symbol: ASIC4;
  Gene Name: acid sensing (proton gated) ion channel family member 4;
  Uniprot ID:  Q96FT7;
  ENSP ID: ENSP00000350786
MLSGAAGAARRGGAALAPSLTRSLAGTHAGADSCAGADKGSHKETIEERDKRQQRQQRQRQHQGCGAAGSGSDSPTSGPHPVPVLFPLALSLEEQPLPPLPLGRAPGLLAREGQGREALASPSSRGQMPIEIVCKIKFAEEDAKPKEKEAGDEQSLLGAVAPGAAPRDLATFASTSTLHGLGRACGPGPHGLRRTLWALALLTSLAAFLYQAAGLARGYLTRPHLVAMDPAAPAPVAGFPAVTLCNINRFRHSALSDADIFHLANLTGLPPKDRDGHRAAGLRYPEPDMVDILNRTGHQLADMLKSCNFSGHHCSASNFSVVYTRYGKCYTFNADPRSSLPSRAGGMGSGLEIMLDIQQEEYLPIWRETNETSFEAGIRVQIHSQEEPPYIHQLGFGVSPGFQTFVSCQEQRLTYLPQPWGNCRAESELREPELQGYSAYSVSACRLRCEKEAVLQRCHCRMVHMPGNETICPPNIYIECADHTLDSLGGGPEGPCFCPTPCNLTRYGKEISMVRIPNRGSARYLARKYNRNETYIRENFLVLDVFFEALTSEAMEQRAAYGLSALLGDLGGQMGLFIGASILTLLEILDYIYEVSWDRLKRVWRRPKTPLRTSTGGISTLGLQELKEQSPCPSRGRVEGGGVSSLLPNHHHPHGPPGGLFEDFAC

SEQ ID NO: 1367 - protein, 505 aa, Homo sapiens
  Payload ID: 405;
  Gene Symbol: ASIC5;
  Gene Name: acid sensing (proton gated) ion channel family member 5;
  Uniprot ID:  Q9NY37;
  ENSP ID: ENSP00000442477
MEQTEKSKVYAENGLLEKIKLCLSKKPLPSPTERKKFDHDFAISTSFHGIHNIVQNRSKIRRVLWLVVVLGSVSLVTWQIYIRLLNYFTWPTTTSIEVQYVEKMEFPAVTFCNLNRFQTDAVAKFGVIFFLWHIVSKVLHLQEITANSTGSREATDFAASHQNFSIVEFIRNKGFYLNNSTLLDCEFFGKPCSPKDFAHVFTEYGNCFTFNHGETLQAKRKVSVSGRGLSLLFNVNQEAFTDNPALGFVDAGIIFVIHSPKKVPQFDGLGLLSPVGMHARVTIRQVKTVHQEYPWGECNPNIKLQNFSSYSTSGCLKECKAQHIKKQCGCVPFLLPGYGIECDLQKYFSCVSPVLDHIEFKDLCTVGTHNSSCPVSCEEIEYPATISYSSFPSQKALKYLSKKLNQSRKYIRENLVKIEINYSDLNYKITQQQKAVSVSELLADLGGQLGLFCGASLITIIEIIEYLFTNFYWICIFFLLKISEMTQWTPPPQNHLGNKNRIEEC

SEQ ID NO: 1368 - protein, 411 aa, Homo sapiens
  Payload ID: 406;
  Gene Symbol: ASIC5;
  Gene Name: Acid sensing ion channel subunit family member 5;
  ENSP ID: ENSP00000461559
MEQTEKSKVYAENGLLEKIKLCLSKKPLPSPTERKKFDHDFAISTSFHGIHNIVQNRSKIRRVLWLVVVLGSVSLVTWQIYIRLLNYFTWPTTTSIEVQYVEKMEFPAVTFCNLNRFQTDAVAKFGVIFFLWHIVSKVLHLQEITANSTGSREATDFAASHQNFSIVEFIRNKGFYLNNSTLLDCEFFGKPCSPKDFAHVFTEYGNCFTFNHGETLQAKRKVSVSGRGLSLLFNVNQEAFTDNPALGFVDAGIIFVIHSPKKVPQFDGLGLLSPVGMHARVTIRQVKTVHQEYPWGECNPNIKLQNFSSYSTSGCLKECKAQHIKKQCGCVPFLLPGYGIECDLQKYFSCVSPVLDHIEFKDLCTVGTHNSSCPVSCEEIEYPATISYSSFPSQKALKYLSKKLNQSRKYI

SEQ ID NO: 1369 - protein, 79 aa, Homo sapiens
  Payload ID: 407;
  Gene Symbol: ANP32A;
  Gene Name: acidic (leu-rich) nuclear phosphoprt 32 family, member A;
  ENSP ID: ENSP00000386496
MEMGRRIHLELRNRTPSDVKELVLDNSRSNEGKLEGLTDEFEELEFLSTINVGLTSIANLPKLNKLKKYWQKSVRTSRI

SEQ ID NO: 1370 - protein, 249 aa, Homo sapiens
  Payload ID: 407;
  Gene Symbol: ANP32A;
  Gene Name: acidic (leu-rich) nuclear phosphoprt 32 family, member A;
  Uniprot ID:  P39687;
  ENSP ID: ENSP00000417864
MEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDEEEYDEDAQVVEDEEDEDEEEEGEEEDVSGEEEEDEEGYNDGEVDDEEDEEELGEEERGQKRKREPEDEGEDDD

SEQ ID NO: 1371 - protein, 177 aa, Homo sapiens
  Payload ID: 407;
  Gene Symbol: ANP32A;
  Gene Name: acidic (leu-rich) nuclear phosphoprt 32 family, member A;
  ENSP ID: ENSP00000453838
MEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDGG

SEQ ID NO: 1372 - protein, 251 aa, Homo sapiens
  Payload ID: 408;
  Gene Symbol: ANP32B;
  Gene Name: acidic (leu-rich) nuclear phosphoprt 32 family, member B;
  Uniprot ID:  Q92688;
  ENSP ID: ENSP00000345848
MDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 1373 - protein, 131 aa, Homo sapiens
  Payload ID: 409;
  Gene Symbol: ANP32D;
  Gene Name: acidic (leu-rich) nuclear phosphoprt 32 family, member D;
  Uniprot ID:  O95626;
  ENSP ID: ENSP00000266594
MEMGKWIHLELRNRTPSDVKELFLDNSQSNEGKLEGLTDEFEELELLNTINIGLTSIANLPKLNKLKKLELSSNRASVGLEVLAEKCPNLIHLNLSGNKIKDLSTIEPLKKLENLESLDLFTCEVTNLNNY

SEQ ID NO: 1374 - protein, 149 aa, Homo sapiens
  Payload ID: 410;
  Gene Symbol: ANP32E;
  Gene Name: acidic (leu-rich) nuclear phosphoprt 32 family, member E;
  ENSP ID: ENSP00000358110
MEMKKKINLELRNRSPEEVTELVLDNCLCVNGEIEGLNDTFKELEFLSMANVELSSLARLPSLNKLRKLELSDNIISGGLEVLAEKCPNLTYLNLSGNKIKDLSTVEALDEEDDDDYVEEGEEEEEEEGGLRGEKRKRDAEDDGEEEDD

SEQ ID NO: 1375 - protein, 136 aa, Homo sapiens
  Payload ID: 410;
  Gene Symbol: ANP32E;
  Gene Name: acidic (leu-rich) nuclear phosphoprt 32 family, member E;
  ENSP ID: ENSP00000358111
MEMKKKINLELRNRSPEEEDNEAPDSEEEDDEDGDEDDEEEEENEAGPPEGYEEEEEEEEEEDEDEDEDEDEAGSELGEGEEEVGLSYLMKEEIQDEEDDDDYVEEGEEEEEEEEGGLRGEKRKRDAEDDGEEEDD

SEQ ID NO: 1376 - protein, 227 aa, Homo sapiens
  Payload ID: 410;
  Gene Symbol: ANP32E;
  Gene Name: acidic (leu-rich) nuclear phosphoprt 32 family, member E;
  Uniprot ID:  Q9BTT0;
  ENSP ID: ENSP00000393718
MEMKKKINLELRNRSPEEVTELVLDNCLCVNGEIEGLNDTFKELEFLSMANVELSSLARLPSLNKLRKQNLKNLKSLDLFNCEITNLEDYRESIFELLQQITYLDGFDQEDNEAPDSEEEDDEDGDEDDEEEEENEAGPPEGYEEEEEEEEEEDEDEDEDEDEAGSELGEGEEEVGLSYLMKEEIQDEEDDDDYVEEGEEEEEEEEGGLRGEKRKRDAEDDGEEEDD

SEQ ID NO: 1377 - protein, 100 aa, Homo sapiens
  Payload ID: 410;
  Gene Symbol: ANP32E;
  Gene Name: acidic (leu-rich) nuclear phosphoprt 32 family, member E;
  ENSP ID: ENSP00000431434
EEEEEEEEDEDEDEDEDEAGSELGEGEEEVGLSYLMKEEIQSEKSYGFFNLQTEYLNFKDEEDDDDYVEEGEEEEEEEEGGLRGEKRKRDAEDDGEEEDD

SEQ ID NO: 1378 - protein, 114 aa, Homo sapiens
  Payload ID: 410;
  Gene Symbol: ANP32E;
  Gene Name: acidic (leu-rich) nuclear phosphoprt 32 family, member E;
  ENSP ID: ENSP00000432684
MEMKKKINLELRNRSPEELELSDNIISGGLEVLAEKCPNLTYLNLSGNKIKDLSTVEALQNLKNLKSLDLFNCEITNLEDYRESIFELLQQITYLDGFDQEDNEAPDSEEEDDE

SEQ ID NO: 1379 - protein, 165 aa, Homo sapiens
  Payload ID: 410;
  Gene Symbol: ANP32E;
  Gene Name: acidic (leu-rich) nuclear phosphoprt 32 family, member E;
  ENSP ID: ENSP00000435215
MEMKKKINLELRNRSPEEVTELVLDNCLCVNGEIEGLNDTFKELEFLSMANVELSSLARLPSLNKLRKLELSDNIISGGLEVLAEKCPNLTYLNLSGNKIKDLSTVEALMAMKMMKRKRKMKLVHRKDMRKRRRKRKRRMRMRMKMKMKQVQSWEREKRKWASHT

SEQ ID NO: 1380 - protein, 105 aa, Homo sapiens
  Payload ID: 410;
  Gene Symbol: ANP32E;
  Gene Name: acidic (leu-rich) nuclear phosphoprt 32 family, member E;
  ENSP ID: ENSP00000436529
MEMKKKINLELRNRSPEEQITYLDGFDQEDNEAPDSEEEDDEDGDEDDEEEEENEAGPPEGYEEEEEEEEEEDEDEDEDEDEAGSELGEGEEEVGLSYLMKEEIQ

SEQ ID NO: 1381 - protein, 268 aa, Homo sapiens
  Payload ID: 410;
  Gene Symbol: ANP32E;
  Gene Name: acidic (leu-rich) nuclear phosphoprt 32 family, member E;
  Uniprot ID:  Q9BTT0;
  ENSP ID: ENSP00000463154
MEMKKKINLELRNRSPEEVTELVLDNCLCVNGEIEGLNDTFKELEFLSMANVELSSLARLPSLNKLRKLELSDNIISGGLEVLAEKCPNLTYLNLSGNKIKDLSTVEALQNLKNLKSLDLFNCEITNLEDYRESIFELLQQITYLDGFDQEDNEAPDSEEEDDEDGDEDDEEEEENEAGPPEGYEEEEEEEEEEDEDEDEDEDEAGSELGEGEEEVGLSYLMKEEIQDEEDDDDYVEEGEEEEEEEEGGLRGEKRKRDAEDDGEEEDD

SEQ ID NO: 1382 - protein, 220 aa, Homo sapiens
  Payload ID: 410;
  Gene Symbol: ANP32E;
  Gene Name: acidic (leu-rich) nuclear phosphoprt 32 family, member E;
  Uniprot ID:  Q9BTT0;
  ENSP ID: ENSP00000481415
MANVELSSLARLPSLNKLRKLELSDNIISGGLEVLAEKCPNLTYLNLSGNKIKDLSTVEALQNLKNLKSLDLFNCEITNLEDYRESIFELLQQITYLDGFDQEDNEAPDSEEEDDEDGDEDDEEEEENEAGPPEGYEEEEEEEEEEDEDEDEDEDEAGSELGEGEEEVGLSYLMKEEIQDEEDDDDYVEEGEEEEEEEEGGLRGEKRKRDAEDDGEEEDD

SEQ ID NO: 1383 - protein, 136 aa, Homo sapiens; identical to SEQ ID NO: 1375
  Payload ID: 410;
  Gene Symbol: ANP32E;
  Gene Name: acidic (leu-rich) nuclear phosphoprt 32 family, member E;
  ENSP ID: ENSP00000487027

SEQ ID NO: 1384 - protein, 691 aa, Homo sapiens
  Payload ID: 411;
  Gene Symbol: ACRC;
  Gene Name: acidic repeat containing;
  Uniprot ID:  Q96QF7;
  ENSP ID: ENSP00000362799
MDGCKKELPRLQEPEEDEDCYILNVQSSSDDTSGSSVARRAPKRQASCILNVQSRSGDTSGSSVARRAPKRQASSVVVIDSDSDEECHTHEEKKAKLLEINSDDESPECCHVKPAIQEPPIVISDDDNDDDNGNDLEVPDDNSDDSEAPDDNSDDSEAPDDNSDDSEAPDDNSDDSEAPDDNSDDSDVPDDNSDDSSDDNSDDSSDDNSDDSDVPDDKSDDSDVPDDSSDDSDVPDDSSDDSEAPDDSSDDSEAPDDSSDDSEAPDDSSDDSEAPDDSSDDSEASDDSSDDSEASDDSSDDSEAPDDKSDDSDVPEDKSDDSDVPDDNSDDLEVPVPAEDLCNEGQIASDEEELVEAAAAVSQHDSSDDAGEQDLGENLSKPPSDPEANPEVSERKLPTEEEPAPVVEQSGKRKSKTKTIVEPPRKRQTKTKNIVEPPRKRQTKTKNIVEPLRKRKAKTKNVSVTPGHKKRGPSKKKPGAAKVEKRKTRTPKCKVPGCFLQDLEKSKKYSGKNLKRNKDELVQRIYDLFNRSVCDKKLPEKLRIGWNNKMVKTAGLCSTGEMWYPKWRRFAKIQIGLKVCDSADRIRDTLIHEMCHAASWLIDGIHDSHGDAWKYYARKSNRIHPELPRVTRCHNYKINYKVHYECTGCKTRIGCYTKSLDTSRFICAKCKGSLVMVPLTQKDGTRIVPHV

SEQ ID NO: 1385 - protein, 691 aa, Homo sapiens; identical to SEQ ID NO: 1384
  Payload ID: 411;
  Gene Symbol: ACRC;
  Gene Name: acidic repeat containing;
  Uniprot ID:  Q96QF7;
  ENSP ID: ENSP00000362800

SEQ ID NO: 1386 - protein, 441 aa, Homo sapiens
  Payload ID: 412;
  Gene Symbol: ARMT1;
  Gene Name: acidic residue methyltransferase 1;
  Uniprot ID:  Q9H993;
  ENSP ID: ENSP00000356263
MAVVPASLSGQDVGSFAYLTIKDRIPQILTKVIDTLHRHKSEFFEKHGEEGVEAEKKAISLLSKLRNELQTDKPFIPLVEKFVDTDIWNQYLEYQQSLLNESDGKSRWFYSPWLLVECYMYRRIHEAIIQSPPIDYFDVFKESKEQNFYGSQESIIALCTHLQQLIRTIEDLDENQLKDEFFKLLQISLWGNKCDLSLSGGESSSQNTNVLNSLEDLKPFILLNDMEHLWSLLSNCKKTREKASATRVYIVLDNSGFELVTDLILADFLLSSELATEVHFYGKTIPWFVSDTTIHDFNWLIEQVKHSNHKWMSKCGADWEEYIKMGKWVYHNHIFWTLPHEYCAMPQVAPDLYAELQKAHLILFKGDLNYRKLTGDRKWEFSVPFHQALNGFHPAPLCTIRTLKAEIQVGLQPGQGEQLLASEPSWWTTGKYGIFQYDGPL

SEQ ID NO: 1387 - protein, 56 aa, Homo sapiens
  Payload ID: 412;
  Gene Symbol: ARMT1;
  Gene Name: acidic residue methyltransferase 1;
  ENSP ID: ENSP00000435882
MAVVPASLSGQDVGKAWKLKRKLSLSFLNYGMNCKQINHLSPWLRNLLILIYGIST

SEQ ID NO: 1388 - protein, 322 aa, Homo sapiens
  Payload ID: 412;
  Gene Symbol: ARMT1;
  Gene Name: acidic residue methyltransferase 1;
  ENSP ID: ENSP00000444121
MYRRIHEAIIQSPPIDYFDVFKESKEQNFYGSQESIIALCTHLQQLIRTIEDLDENQLKDEFFKLLQISLWGNKCDLSLSGGESSSQNTNVLNSLEDLKPFILLNDMEHLWSLLSNCKKTREKASATRVYIVLDNSGFELVTDLILADFLLSSELATEVHFYGKTIPWFVSDTTIHDFNWLIEQVKHSNHKWMSKCGADWEEYIKMGKWVYHNHIFWTLPHEYCAMPQVAPDLYAELQKAHLILFKGDLNYRKLTGDRKWEFSVPFHQALNGFHPAPLCTIRTLKAEIQVGLQPGQGEQLLASEPSWWTTGKYGIFQYDGPL

SEQ ID NO: 1389 - protein, 179 aa, Homo sapiens
  Payload ID: 413;
  Gene Symbol: ADI1;
  Gene Name: acireductone dioxygenase 1;
  Uniprot ID:  Q9BV57;
  ENSP ID: ENSP00000333666
MVQAWYMDDAPGDPRQPHRPDPGRPVGLEQLRRLGVLYWKLDADKYENDPELEKIRRERNYSWMDIITICKDKLPNYEEKIKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTA

SEQ ID NO: 1390 - protein, 173 aa, Homo sapiens
  Payload ID: 413;
  Gene Symbol: ADI1;
  Gene Name: acireductone dioxygenase 1;
  Uniprot ID:  Q9BV57;
  ENSP ID: ENSP00000371525
MSVKSSKLMFLCHGSSRSLHSGSLTSCNTGVCCSLDADKYENDPELEKIRRERNYSWMDIITICKDKLPNYEEKIKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTA

SEQ ID NO: 1391 - protein, 117 aa, Homo sapiens
  Payload ID: 413;
  Gene Symbol: ADI1;
  Gene Name: acireductone dioxygenase 1;
  ENSP ID: ENSP00000410178
  MOD_RES (1)..(1): Any amino acid
XRWECCAFSPGPACVVALAVASLPLNCAASADSKRGRWARDSSTCASRRVCGAAGDVRGDSCPSVAASVAPACDPGGQNYTKAMRLFVGEPVWTAYNRPADHFEARGQYVKFLAQTA

SEQ ID NO: 1392 - protein, 99 aa, Homo sapiens
  Payload ID: 413;
  Gene Symbol: ADI1;
  Gene Name: acireductone dioxygenase 1;
  ENSP ID: ENSP00000486013
IKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTA

SEQ ID NO: 1393 - protein, 889 aa, Homo sapiens
  Payload ID: 414;
  Gene Symbol: ACO1;
  Gene Name: aconitase 1, soluble;
  Uniprot ID:  P21399;
  ENSP ID: ENSP00000309477
MSNPFAHLAEPLDPVQPGKKFFNLNKLEDSRYGRLPFSIRVLLEAAIRNCDEFLVKKQDIENILHWNVTQHKNIEVPFKPARVILQDFTGVPAVVDFAAMRDAVKKLGGDPEKINPVCPADLVIDHSIQVDFNRRADSLQKNQDLEFERNRERFEFLKWGSQAFHNMRIIPPGSGIIHQVNLEYLARVVFDQDGYYYPDSLVGTDSHTTMIDGLGILGWGVGGIEAEAVMLGQPISMVLPQVIGYRLMGKPHPLVTSTDIVLTITKHLRQVGVVGKFVEFFGPGVAQLSIADRATIANMCPEYGATAAFFPVDEVSITYLVQTGRDEEKLKYIKKYLQAVGMFRDFNDPSQDPDFTQVVELDLKTVVPCCSGPKRPQDKVAVSDMKKDFESCLGAKQGFKGFQVAPEHHNDHKTFIYDNTEFTLAHGSVVIAAITSCTNTSNPSVMLGAGLLAKKAVDAGLNVMPYIKTSLSPGSGVVTYYLQESGVMPYLSQLGFDVVGYGCMTCIGNSGPLPEPVVEAITQGDLVAVGVLSGNRNFEGRVHPNTRANYLASPPLVIAYAIAGTIRIDFEKEPLGVNAKGQQVFLKDIWPTRDEIQAVERQYVIPGMFKEVYQKIETVNESWNALATPSDKLFFWNSKSTYIKSPPFFENLTLDLQPPKSIVDAYVLLNLGDSVTTDHISPAGNIARNSPAARYLTNRGLTPREFNSYGSRRGNDAVMARGTFANIRLLNRFLNKQAPQTIHLPSGEILDVFDAAERYQQAGLPLIVLAGKEYGAGSSRDWAAKGPFLLGIKAVLAESYERIHRSNLVGMGVIPLEYLPGENADALGLTGQERYTIIIPENLKPQMKVQVKLDTGKTFQAVMRFDTDVELTYFLNGGILNYMIRKMAK

SEQ ID NO: 1394 - protein, 889 aa, Homo sapiens; identical to SEQ ID NO: 1393
  Payload ID: 414;
  Gene Symbol: ACO1;
  Gene Name: aconitase 1, soluble;
  Uniprot ID:  P21399;
  ENSP ID: ENSP00000369255

SEQ ID NO: 1395 - protein, 889 aa, Homo sapiens; identical to SEQ ID NO: 1393
  Payload ID: 414;
  Gene Symbol: ACO1;
  Gene Name: aconitase 1, soluble;
  Uniprot ID:  P21399;
  ENSP ID: ENSP00000438733

SEQ ID NO: 1396 - protein, 780 aa, Homo sapiens
  Payload ID: 415;
  Gene Symbol: ACO2;
  Gene Name: aconitase 2, mitochondrial;
  Uniprot ID:  Q99798;
  ENSP ID: ENSP00000216254
MAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVSPTSQRLQLLEPFDKWDGKDLEDLQILIKVKGKCTTDHISAAGPWLKFRGHLDNISNNLLIGAINIENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 1397 - protein, 805 aa, Homo sapiens
  Payload ID: 415;
  Gene Symbol: ACO2;
  Gene Name: aconitase 2, mitochondrial;
  ENSP ID: ENSP00000379769
MAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGEEGGQATWPLPCAGPDGSPVGSRSGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVSPTSQRLQLLEPFDKWDGKDLEDLQILIKVKGKCTTDHISAAGPWLKFRGHLDNISNNLLIGAINIENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 1398 - protein, 421 aa, Homo sapiens
  Payload ID: 416;
  Gene Symbol: ACR;
  Gene Name: acrosin;
  Uniprot ID:  P10323;
  ENSP ID: ENSP00000216139
MVEMLPTAILLVLAVSVVAKDNATCDGPCGLRFRQNPQGGVRIVGGKAAQHGAWPWMVSLQIFTYNSHRYHTCGGSLLNSRWVLTAAHCFVGKNNVHDWRLVFGAKEITYGNNKPVKAPLQERYVEKIIIHEKYNSATEGNDIALVEITPPISCGRFIGPGCLPHFKAGLPRGSQSCWVAGWGYIEEKAPRPSSILMEARVDLIDLDLCNSTQWYNGRVQPTNVCAGYPVGKIDTCQGDSGGPLMCKDSKESAYVVVGITSWGVGCARAKRPGIYTATWPYLNWIASKIGSNALRMIQSATPPPPTTRPPPIRPPFSHPISAHLPWYFQPPPRPLPPRPPAAQPRPPPSPPPPPPPPASPLPPPPPPPPPTPSSTTKLPQGLSFAKRLQQLIEVLKGKTYSDGKNHYDMETTELPELTSTS

SEQ ID NO: 1399 - protein, 212 aa, Homo sapiens
  Payload ID: 416;
  Gene Symbol: ACR;
  Gene Name: acrosin;
  ENSP ID: ENSP00000435120
MVEMLPTAILLVLAVSVVAKDNATCDGPCGLRFRQNPQGGVRIVGGKAAQHGAWPWMVSLQIFTYNSHRYHTCGGSLLNSRWVLTAAHCFVGKNNVHDWRLVFGAKEITYGNNKPVKAPLQERYVEKIIIHEKYNSATEGNDIALVEITPPISCGRFIGPGCLPHFKAGLPRGSQSCWVAGWGYIEEKGFLECPAGTSPFKTGVAVALELCP

SEQ ID NO: 1400 - protein, 543 aa, Homo sapiens
  Payload ID: 417;
  Gene Symbol: ACRBP;
  Gene Name: acrosin binding prt;
  Uniprot ID:  Q8NEB7;
  ENSP ID: ENSP00000229243
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 1401 - protein, 510 aa, Homo sapiens
  Payload ID: 417;
  Gene Symbol: ACRBP;
  Gene Name: acrosin binding prt;
  ENSP ID: ENSP00000402725
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 1402 - protein, 173 aa, Homo sapiens
  Payload ID: 417;
  Gene Symbol: ACRBP;
  Gene Name: acrosin binding prt;
  ENSP ID: ENSP00000438656
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTERQTFQPWPERLSNN

SEQ ID NO: 1403 - protein, 319 aa, Homo sapiens
  Payload ID: 417;
  Gene Symbol: ACRBP;
  Gene Name: acrosin binding prt;
  ENSP ID: ENSP00000443153
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGRYRKF

SEQ ID NO: 1404 - protein, 100 aa, Homo sapiens
  Payload ID: 417;
  Gene Symbol: ACRBP;
  Gene Name: acrosin binding prt;
  ENSP ID: ENSP00000445262
MRKPAAGFLPSLLKVLLLPLAPAAAQDSTQASTPGSPLSPTEYERFFALLTPTWKAETTCRLRATHGCRNPTLVQLDQYENHGLVPDESPVFPASLYSLT

SEQ ID NO: 1405 - protein, 246 aa, Homo sapiens
  Payload ID: 418;
  Gene Symbol: ACRV1;
  Gene Name: acrosomal vesicle prt 1;
  Uniprot ID:  P26436;
  ENSP ID: ENSP00000317684
MNRFLLLMSLYLLGSARGTSSQPNELSGSIDHQTSVQQLPGEFFSLENPSDAEALYETSSGLNTLSEHGSSEHGSSKHTVAEHTSGEHAESEHASGEPAATEHAEGEHTVGEQPSGEQPSGEHLSGEQPLSELESGEQPSDEQPSGEHGSGEQPSGEQASGEQPSGTILNCYTCAYMNDQGKCLRGEGTCITQNSQQCMLKKIFEGGKLQFMVQGCENMCPSMNLFSHGTRMQIICCRNQSFCNKI

SEQ ID NO: 1406 - protein, 265 aa, Homo sapiens
  Payload ID: 418;
  Gene Symbol: ACRV1;
  Gene Name: acrosomal vesicle prt 1;
  Uniprot ID:  P26436;
  ENSP ID: ENSP00000432816
MNRFLLLMSLYLLGSARGTSSQPNELSGSIDHQTSVQQLPGEFFSLENPSDAEALYETSSGLNTLSEHGSSEHGSSKHTVAEHTSGEHAESEHASGEPAATEHAEGEHTVGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 1407 - protein, 210 aa, Homo sapiens
  Payload ID: 418;
  Gene Symbol: ACRV1;
  Gene Name: acrosomal vesicle prt 1;
  Uniprot ID:  P26436;
  ENSP ID: ENSP00000433720
MNRFLLLMSLYLLGSARGTSSQPNELSGSIDHQTSVQQLPGEPAATEHAEGEHTVGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 1408 - protein, 195 aa, Homo sapiens
  Payload ID: 418;
  Gene Symbol: ACRV1;
  Gene Name: acrosomal vesicle prt 1;
  Uniprot ID:  P26436;
  ENSP ID: ENSP00000436819
MNRFLLLMSLYLLGSARGTSSQPNELSGSIDHQTSVQQLPGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 1409 - protein, 778 aa, Homo sapiens
  Payload ID: 419;
  Gene Symbol: ABLIM1;
  Gene Name: actin binding LIM prt 1;
  Uniprot ID:  O14639;
  ENSP ID: ENSP00000277895
MPAFLGLKCLGKLCSSEKSKVTSSERTSARGSNRKRLIVEDRRVSGTSFTAHRRATITHLLYLCPKDYCPRGRVCNSVDPFVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 1410 - protein, 746 aa, Homo sapiens
  Payload ID: 419;
  Gene Symbol: ABLIM1;
  Gene Name: actin binding LIM prt 1;
  ENSP ID: ENSP00000358256
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDFQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 1411 - protein, 401 aa, Homo sapiens
  Payload ID: 419;
  Gene Symbol: ABLIM1;
  Gene Name: actin binding LIM prt 1;
  Uniprot ID:  O14639;
  ENSP ID: ENSP00000358257
MFTEGEEMYLQGSTVWHPDCKQSTKTEEKLRAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 1412 - protein, 748 aa, Homo sapiens
  Payload ID: 419;
  Gene Symbol: ABLIM1;
  Gene Name: actin binding LIM prt 1;
  Uniprot ID:  O14639;
  ENSP ID: ENSP00000358260
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHDAAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 1413 - protein, 401 aa, Homo sapiens [sequence omitted]

SEQ ID NO: 1414 - protein, 455 aa, Homo sapiens
  Payload ID: 419;
  Gene Symbol: ABLIM1;
  Gene Name: actin binding LIM prt 1;
  Uniprot ID:  O14639;
  ENSP ID: ENSP00000376679
MFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 1415 - protein, 718 aa, Homo sapiens
  Payload ID: 419;
  Gene Symbol: ABLIM1;
  Gene Name: actin binding LIM prt 1;
  Uniprot ID:  O14639;
  ENSP ID: ENSP00000376682
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 1416 - protein, 173 aa, Homo sapiens
  Payload ID: 419;
  Gene Symbol: ABLIM1;
  Gene Name: actin binding LIM prt 1;
  ENSP ID: ENSP00000400934
MFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRK

SEQ ID NO: 1417 - protein, 172 aa, Homo sapiens
  Payload ID: 419;
  Gene Symbol: ABLIM1;
  Gene Name: actin binding LIM prt 1;
  ENSP ID: ENSP00000414154
CKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHVLFEVILLLLI

SEQ ID NO: 1418 - protein, 718 aa, Homo sapiens
  Payload ID: 419;
  Gene Symbol: ABLIM1;
  Gene Name: actin binding LIM prt 1;
  ENSP ID: ENSP00000433629
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDFQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 1419 - protein, 644 aa, Homo sapiens
  Payload ID: 420;
  Gene Symbol: ABLIM2;
  Gene Name: actin binding LIM prt family, member 2;
  ENSP ID: ENSP00000317020
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPAGTVSVGTSSCLSLSQHPSPTSVFRHHYIPYFRGSESGRSTPSLSVLSDSKPPPPPTSRHLATHVPDTGVKDNIYRKPPIYRQHAARRSDGEDGSLDQDNRKQKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 1420 - protein, 611 aa, Homo sapiens
  Payload ID: 420;
  Gene Symbol: ABLIM2;
  Gene Name: actin binding LIM prt family, member 2;
  Uniprot ID:  Q6H8Q1;
  ENSP ID: ENSP00000342813
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPGSESGRSTPSLSVLSDSKPPPSTYQQAPRHFHVPDTGVKDNIYRKPPIYRQHAARRSDGEDGSLDQDNRKKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 1421 - protein, 531 aa, Homo sapiens
  Payload ID: 420;
  Gene Symbol: ABLIM2;
  Gene Name: actin binding LIM prt family, member 2;
  Uniprot ID:  Q6H8Q1;
  ENSP ID: ENSP00000354887
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPAARRSDGEDGSLDQDNRKKSSWLMLKGDADTRTNSPDLDTQSLSHSSGTDRDPLQRMAGDSFHSQYKIYPYDSLIVTNRIRVKLPKDVDRTRLERHLSPEEFQEVFGMSIEEFDRLALWKRNDLKKKALLF

SEQ ID NO: 1422 - protein, 572 aa, Homo sapiens
  Payload ID: 420;
  Gene Symbol: ABLIM2;
  Gene Name: actin binding LIM prt family, member 2;
  Uniprot ID:  Q6H8Q1;
  ENSP ID: ENSP00000355003
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPGSESGRSTPSLSVLSDSKPPPSTYQQAPRHFHVPDTGVKDNIYRKPPIYRQHAARRSDGEDGSLDQDNRKKSSWLMLKGDADTRTNSPDLDTQSLSHSSGTDRDPLQRMAGDSFHSQYKIYPYDSLIVTNRIRVKLPKDVDRTRLERHLSPEEFQEVFGMSIEEFDRLALWKRNDLKKKALLF

SEQ ID NO: 1423 - protein, 521 aa, Homo sapiens
  Payload ID: 420;
  Gene Symbol: ABLIM2;
  Gene Name: actin binding LIM prt family, member 2;
  Uniprot ID:  Q6H8Q1;
  ENSP ID: ENSP00000384658
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPAARRSDGEDGSLDQDNRKQKSSWLMLKGDADTRTNSPDLDTQSLSHSSGTDRDPLQRMAGDSFHSQYKIYPYDSLIVTNRIRVKLPKDVDRTRLERHLSPEEFQEVFGMSIEEFDRLALWKRNDLKKKALLF

SEQ ID NO: 1424 - protein, 470 aa, Homo sapiens
  Payload ID: 420;
  Gene Symbol: ABLIM2;
  Gene Name: actin binding LIM prt family, member 2;
  Uniprot ID:  Q6H8Q1;
  ENSP ID: ENSP00000389410
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPAARRSDGEDGSLDQDNRKQKSSWLMLKGDADTRTNSPDLDTQSLSHSSGTDRDPLQRMAGDSFHSREWFF

SEQ ID NO: 1425 - protein, 645 aa, Homo sapiens
  Payload ID: 420;
  Gene Symbol: ABLIM2;
  Gene Name: actin binding LIM prt family, member 2;
  Uniprot ID:  Q6H8Q1;
  ENSP ID: ENSP00000393511
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPAGTVSVGTSSCLSLSQHPSPTSVFRHHYIPYFRGSESGRSTPSLSVLSDSKPPPSTYQQAPRHFHVPDTGVKDNIYRKPPIYRQHAARRSDGEDGSLDQDNRKQKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 1426 - protein, 559 aa, Homo sapiens
  Payload ID: 420;
  Gene Symbol: ABLIM2;
  Gene Name: actin binding LIM prt family, member 2;
  Uniprot ID:  Q6H8Q1;
  ENSP ID: ENSP00000421283
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPAARRSDGEDGSLDQDNRKKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 1427 - protein, 305 aa, Homo sapiens
  Payload ID: 420;
  Gene Symbol: ABLIM2;
  Gene Name: actin binding LIM prt family, member 2;
  ENSP ID: ENSP00000421718
MFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPAGTVSVGTSSCLSLSQHPSPTSVFRHHYIPYFRGSESGRSTPSLSVLSDSKPPPSTYQQAPRHFHVPDTGVKDNIYRKPPIYRQHAARRSDGEDGSLDQDNRKKSSWLMLKGDADTRTNSPDLDTQSLSHSSGTDRDPLQRMAGDSFH

SEQ ID NO: 1428 - protein, 346 aa, Homo sapiens
  Payload ID: 420;
  Gene Symbol: ABLIM2;
  Gene Name: actin binding LIM prt family, member 2;
  Uniprot ID:  Q6H8Q1;
  ENSP ID: ENSP00000423661
MFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPDTGVKDNIYRKPPIYRQHAARRSDGEDGSLDQDNRKQKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 1429 - protein, 646 aa, Homo sapiens [sequence omitted]

SEQ ID NO: 1430 - protein, 683 aa, Homo sapiens
  Payload ID: 421;
  Gene Symbol: ABLIM3;
  Gene Name: actin binding LIM prt family, member 3;
  Uniprot ID:  O94929;
  ENSP ID: ENSP00000310309
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICAKVDNEILNYKDLAALPKVKSIYEVQRPDLISYEPHSRYMSDEMLERCGYGESLGTLSPYSQDIYENLDLRQRRASSPGYIDSPTYSRQGMSPTFSRSPHHYYRSGPESGRSSPYHSQLDVRSSTPTSYQAPKHFHIPAGDSNIYRKPPIYKRHGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 1431 - protein, 588 aa, Homo sapiens
  Payload ID: 421;
  Gene Symbol: ABLIM3;
  Gene Name: actin binding LIM prt family, member 3;
  Uniprot ID:  O94929;
  ENSP ID: ENSP00000315841
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICDIYENLDLRQRRASSPGYIDSPTYSRQGMSPTFSRSPHHYYRSAGDSNIYRKPPIYKRHGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 1432 - protein, 170 aa, Homo sapiens [sequence omitted]

SEQ ID NO: 1433 - protein, 650 aa, Homo sapiens
  Payload ID: 421;
  Gene Symbol: ABLIM3;
  Gene Name: actin binding LIM prt family, member 3;
  ENSP ID: ENSP00000420855
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICAKVDNEILNYKDLAALPKVKSIYEVQRPDLISYEPHSRYMSDEMLERCGYGESLGTLSPYSQDIYENLDLRQRRASSPGYIDSPTYSRQGMSPTFSRSPHHYYRSAGDSNIYRKPPIYKRHGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 1434 - protein, 151 aa, Homo sapiens
  Payload ID: 421;
  Gene Symbol: ABLIM3;
  Gene Name: actin binding LIM prt family, member 3;
  ENSP ID: ENSP00000421002
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRTSPGMESSSLPPALPSASPSLVNSASEAFPHWRQGDLQR

SEQ ID NO: 1435 - protein, 544 aa, Homo sapiens
  Payload ID: 421;
  Gene Symbol: ABLIM3;
  Gene Name: actin binding LIM prt family, member 3;
  Uniprot ID:  O94929;
  ENSP ID: ENSP00000421183
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICDIYENLDLRQRRASSPGYIDSPTYSRQGMSPTFSRSPHHYYRSGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLEGNFWKSGCL

SEQ ID NO: 1436 - protein, 683 aa, Homo sapiens; identical to SEQ ID NO: 1430
  Payload ID: 421;
  Gene Symbol: ABLIM3;
  Gene Name: actin binding LIM prt family, member 3;
  Uniprot ID:  O94929;
  ENSP ID: ENSP00000425394

SEQ ID NO: 1437 - protein, 169 aa, Homo sapiens
  Payload ID: 421;
  Gene Symbol: ABLIM3;
  Gene Name: actin binding LIM prt family, member 3;
  Uniprot ID:  O94929;
  ENSP ID: ENSP00000430150
MHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 1438 - protein, 381 aa, Homo sapiens
  Payload ID: 422;
  Gene Symbol: ABRA;
  Gene Name: actin binding Rho activating prt;
  Uniprot ID:  Q8N0Z2;
  ENSP ID: ENSP00000311436
MAPGEKESGEGPAKSALRKIRTATLVISLARGWQQWANENSIRQAQEPTGWLPGGTQDSPQAPKPITPPTSHQKAQSAPKSPPRLPEGHGDGQSSEKAPEVSHIKKKEVSKTVVSKTYERGGDVSHLSHRYERDAGVLEPGQPENDIDRILHSHGSPTRRRKCANLVSELTKGWRVMEQEEPTWRSDSVDTEDSGYGGEAEERPEQDGVQVAVVRIKRPLPSQVNRFTEKLNCKAQQKYSPVGNLKGRWQQWADEHIQSQKLNPFSEEFDYELAMSTRLHKGDEGYGRPKEGTKTAERAKRAEEHIYREMMDMCFIICTMARHRRDGKIQVTFGDLFDRYVRISDKVVGILMRARKHGLVDFEGEMLWQGRDDHVVITLLK

SEQ ID NO: 1439 - protein, 730 aa, Homo sapiens
  Payload ID: 423;
  Gene Symbol: AFAP1;
  Gene Name: actin filament associated prt 1;
  Uniprot ID:  Q8N556;
  ENSP ID: ENSP00000351245
MEELIVELRLFLELLDHEYLTSTVREKKAVITNILLRIQSSKGFDVKDHAQKQETANSLPAPPQMPLPEIPQPWLPPDSGPPPLPTSSLPEGYYEEAVPLSPGKAPEYITSNYDSDAMSSSYESYDEEEEDGKGKKTRHQWPSEEASMDLVKDAKICAFLLRKKRFGQWTKLLCVIKDTKLLCYKSSKDQQPQMELPLQGCNITYIPKDSKKKKHELKITQQGTDPLVLAVQSKEQAEQWLKVIKEAYSGCSGPVDSECPPPPSSPVHKAELEKKLSSERPSSDGEGVVENGITTCNGKEQVKRKKSSKSEAKGTVSKVTGKKITKIISLGKKKPSTDEQTSSAEEDVPTCGYLNVLSNSRWRERWCRVKDNKLIFHKDRTDLKTHIVSIPLRGCEVIPGLDSKHPLTFRLLRNGQEVAVLEASSSEDMGRWIGILLAETGSSTDPEALHYDYIDVEMSASVIQTAKQTFCFMNRRVISANPYLGGTSNGYAHPSGTALHYDDVPCINGSLKGKKPPVASNGVTGKGKTLSSQPKKADPAAVVKRTGSNAAQYKYGKNRVEADAKRLQTKEEELLKRKEALRNRLAQLRKERKDLRAAIEVNAGRKPQAILEEKLKQLEEECRQKEAERVSLELELTEVKESLKKALAGGVTLGLAIEPKSGTSSPQSPVFRHRTLENSPISSCDTSDTEGPVPVNSAAVLKKSQAAPGSSPCRGHVLRKAKEWELKNGT

SEQ ID NO: 1440 - protein, 730 aa, Homo sapiens; identical to SEQ ID NO: 1439
  Payload ID: 423;
  Gene Symbol: AFAP1;
  Gene Name: actin filament associated prt 1;
  Uniprot ID:  Q8N556;
  ENSP ID: ENSP00000353402

SEQ ID NO: 1441 - protein, 814 aa, Homo sapiens
  Payload ID: 423;
  Gene Symbol: AFAP1;
  Gene Name: actin filament associated prt 1;
  Uniprot ID:  Q8N556;
  ENSP ID: ENSP00000371983
MEELIVELRLFLELLDHEYLTSTVREKKAVITNILLRIQSSKGFDVKDHAQKQETANSLPAPPQMPLPEIPQPWLPPDSGPPPLPTSSLPEGYYEEAVPLSPGKAPEYITSNYDSDAMSSSYESYDEEEEDGKGKKTRHQWPSEEASMDLVKDAKICAFLLRKKRFGQWTKLLCVIKDTKLLCYKSSKDQQPQMELPLQGCNITYIPKDSKKKKHELKITQQGTDPLVLAVQSKEQAEQWLKVIKEAYSGCSGPVDSECPPPPSSPVHKAELEKKLSSERPSSDGEGVVENGITTCNGKEQVKRKKSSKSEAKGTVSKVTGKKITKIISLGKKKPSTDEQTSSAEEDVPTCGYLNVLSNSRWRERWCRVKDNKLIFHKDRTDLKTHIVSIPLRGCEVIPGLDSKHPLTFRLLRNGQEVAVLEASSSEDMGRWIGILLAETGSSTDPEALHYDYIDVEMSASVIQTAKQTFCFMNRRVISANPYLGGTSNGYAHPSGTALHYDDVPCINGSWEPEDGFPASCSRGLGEEVLYDNAGLYDNLPPPHIFARYSPADRKASRLSADKLSSNHYKYPASAQSVTNTSSVGRASLGLNSQLKGKKPPVASNGVTGKGKTLSSQPKKADPAAVVKRTGSNAAQYKYGKNRVEADAKRLQTKEEELLKRKEALRNRLAQLRKERKDLRAAIEVNAGRKPQAILEEKLKQLEEECRQKEAERVSLELELTEVKESLKKALAGGVTLGLAIEPKSGTSSPQSPVFRHRTLENSPISSCDTSDTEGPVPVNSAAVLKKSQAAPGSSPCRGHVLRKAKEWELKNGT

SEQ ID NO: 1442 - protein, 814 aa, Homo sapiens; identical to SEQ ID NO: 1441
  Payload ID: 423;
  Gene Symbol: AFAP1;
  Gene Name: actin filament associated prt 1;
  Uniprot ID:  Q8N556;
  ENSP ID: ENSP00000410689

SEQ ID NO: 1443 - protein, 92 aa, Homo sapiens
  Payload ID: 423;
  Gene Symbol: AFAP1;
  Gene Name: actin filament associated prt 1;
  ENSP ID: ENSP00000483962
GITTCNGKEQVKRKKSSKSEAKGTVSKVTGKKITKIISLGKKKPSTDEQTSSAEEDVPTCGKTALPGDEQRAPKWVSFSPAVVSVPSSSKAR

SEQ ID NO: 1444 - protein, 768 aa, Homo sapiens
  Payload ID: 424;
  Gene Symbol: AFAP1L1;
  Gene Name: actin filament associated prt 1-like 1;
  Uniprot ID:  Q8TED9;
  ENSP ID: ENSP00000296721
MDRGQVLEQLLPELTGLLSLLDHEYLSDTTLEKKMAVASILQSLQPLPAKEVSYLYVNTADLHSGPSFVESLFEEFDCDLSDLRDMPEDDGEPSKGASPELAKSPRLRNAADLPPPLPNKPPPEDYYEEALPLGPGKSPEYISSHNGCSPSHSIVDGYYEDADSSYPATRVNGELKSSYNDSDAMSSSYESYDEEEEEGKSPQPRHQWPSEEASMHLVRECRICAFLLRKKRFGQWAKQLTVIREDQLLCYKSSKDRQPHLRLALDTCSIIYVPKDSRHKRHELRFTQGATEVLVLALQSREQAEEWLKVIREVSKPVGGAEGVEVPRSPVLLCKLDLDKRLSQEKQTSDSDSVGVGDNCSTLGRRETCDHGKGKKSSLAELKGSMSRAAGRKITRIIGFSKKKTLADDLQTSSTEEEVPCCGYLNVLVNQGWKERWCRLKCNTLYFHKDHMDLRTHVNAIALQGCEVAPGFGPRHPFAFRILRNRQEVAILEASCSEDMGRWLGLLLVEMGSRVTPEALHYDYVDVETLTSIVSAGRNSFLYARSCQNQWPEPRVYDDVPYEKMQDEEPERPTGAQVKRHASSCSEKSHRVDPQVKVKRHASSANQYKYGKNRAEEDARRYLVEKEKLEKEKETIRTELIALRQEKRELKEAIRSSPGAKLKALEEAVATLEAQCRAKEERRIDLELKLVAVKERLQQSLAGGPALGLSVSSKPKSGETANKPQNSVPEQPLPVNCVSELRKRSPSIVASNQGRVLQKAKEWEMKKT

SEQ ID NO: 1445 - protein, 725 aa, Homo sapiens
  Payload ID: 424;
  Gene Symbol: AFAP1L1;
  Gene Name: actin filament associated prt 1-like 1;
  Uniprot ID:  Q8TED9;
  ENSP ID: ENSP00000424427
MDRGQVLEQLLPELTGLLSLLDHEYLSDTTLEKKMAVASILQSLQPLPAKEVSYLYVNTADLHSGPSFVESLFEEFDCDLSDLRDMPEDDGEPSKGASPELAKSPRLRNAADLPPPLPNKPPPEDYYEEALPLGPGKSPEYISSHNGCSPSHSIVDGYYEDADSSYPATRVNGELKSSYNDSDAMSSSYESYDEEEEEGKSPQPRHQWPSEEASMHLVRECRICAFLLRKKRFGQWAKQLTVIREDQLLCYKSSKDRQPHLRLALDTCSIIYVPKDSRHKRHELRFTQGATEVLVLALQSREQAEEWLKVIREVSKPVGGAEGVEVPRSPVLLCKLDLDKRLSQEKQTSDSDSVGVGDNCSTLGRRETCDHGKGKKSSLAELKGSMSRAAGRKITRIIGFSKKKTLADDLQTSSTEEEVPCCGYLNVLVNQGWKERWCRLKCNTLYFHKDHMDLRTHVNAIALQGCEVAPGFGPRHPFAFRILRNRQEVAILEASCSEDMGRWLGLLLVEMGSRVTPEALHYDYVDVETLTSIVSAGRNSFLYARSCQNQWPEPRVYDDVPYEKMQDEEPERPTGAQVKRHASSCSEKSHRVDPQVKVKRHASSANQYKYGKNRAEEDARRYLVEKEKLEKEKETIRTELIALRQEKRELKEAIRSSPGAKLKALEEAVATLEAQCRAKEERRIDLELKLVAVKERLQQSLAGGPALGLSVSSKPKSGEWEMKKT

SEQ ID NO: 1446 - protein, 818 aa, Homo sapiens
  Payload ID: 425;
  Gene Symbol: AFAP1L2;
  Gene Name: actin filament associated prt 1-like 2;
  Uniprot ID:  Q8N4X5;
  ENSP ID: ENSP00000303042
MERYKALEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQKPDIAEKYLSASEYGSSVDGHPEVPETKDVKKKCSAGLKLSNLMNLGRKKSTSLEPVERSLETSSYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENVSPRPKAVTPASAPDCTPVNSATTLKNRPLSVVVTGKGTVLQKAKEWEKKGAS

SEQ ID NO: 1447 - protein, 814 aa, Homo sapiens
  Payload ID: 425;
  Gene Symbol: AFAP1L2;
  Gene Name: actin filament associated prt 1-like 2;
  Uniprot ID:  Q8N4X5;
  ENSP ID: ENSP00000358276
MERYKALEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQKPDIAEKYLSASEYGSSVDGHPEVPETKDVKKKCSAGLKLSNLMNLGRKKSTSLEPVERSLETSSYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENPKAVTPASAPDCTPVNSATTLKNRPLSVVVTGKGTVLQKAKEWEKKGAS

SEQ ID NO: 1448 - protein, 312 aa, Homo sapiens
  Payload ID: 425;
  Gene Symbol: AFAP1L2;
  Gene Name: actin filament associated prt 1-like 2;
  ENSP ID: ENSP00000396781
MERYKAQGCCCLVVQRRIRQVSASLEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQK

SEQ ID NO: 1449 - protein, 375 aa, Homo sapiens
  Payload ID: 426;
  Gene Symbol: ACTG1;
  Gene Name: actin gamma 1;
  Uniprot ID:  P63261;
  ENSP ID: ENSP00000331514
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 1450 - protein, 375 aa, Homo sapiens; identical to SEQ ID NO: 1449
  Payload ID: 426;
  Gene Symbol: ACTG1;
  Gene Name: actin gamma 1;
  Uniprot ID:  P63261;
  ENSP ID: ENSP00000458162

SEQ ID NO: 1451 - protein, 375 aa, Homo sapiens; identical to SEQ ID NO: 1449
  Payload ID: 426;
  Gene Symbol: ACTG1;
  Gene Name: actin gamma 1;
  Uniprot ID:  P63261;
  ENSP ID: ENSP00000458435

SEQ ID NO: 1452 - protein, 214 aa, Homo sapiens
  Payload ID: 426;
  Gene Symbol: ACTG1;
  Gene Name: actin gamma 1;
  ENSP ID: ENSP00000459119
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKE

SEQ ID NO: 1453 - protein, 375 aa, Homo sapiens; identical to SEQ ID NO: 1449
  Payload ID: 426;
  Gene Symbol: ACTG1;
  Gene Name: actin gamma 1;
  Uniprot ID:  P63261;
  ENSP ID: ENSP00000459124

SEQ ID NO: 1454 - protein, 214 aa, Homo sapiens; identical to SEQ ID NO: 1452
  Payload ID: 426;
  Gene Symbol: ACTG1;
  Gene Name: actin gamma 1;
  ENSP ID: ENSP00000460464

SEQ ID NO: 1455 - protein, 164 aa, Homo sapiens
  Payload ID: 426;
  Gene Symbol: ACTG1;
  Gene Name: actin gamma 1;
  ENSP ID: ENSP00000460660
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVP

SEQ ID NO: 1456 - protein, 241 aa, Homo sapiens
  Payload ID: 426;
  Gene Symbol: ACTG1;
  Gene Name: actin gamma 1;
  ENSP ID: ENSP00000461407
MEEEIAALVIDNGSGMCKAGFAGDDAPRAVFPSIVGRPRHQDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITI

SEQ ID NO: 1457 - protein, 375 aa, Homo sapiens; identical to SEQ ID NO: 1449
  Payload ID: 426;
  Gene Symbol: ACTG1;
  Gene Name: actin gamma 1;
  Uniprot ID:  P63261;
  ENSP ID: ENSP00000461672

SEQ ID NO: 1458 - protein, 198 aa, Homo sapiens
  Payload ID: 426;
  Gene Symbol: ACTG1;
  Gene Name: actin gamma 1;
  ENSP ID: ENSP00000462823
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQALFLSRHFLPEASRLCLRPSTPRPCTWPSRPCCPSTPLGAPLALSWTLETGSPTRCPSTRATPSPTPSCVWTWLAGT

SEQ ID NO: 1459 - protein, 133 aa, Homo sapiens
  Payload ID: 426;
  Gene Symbol: ACTG1;
  Gene Name: actin gamma 1;
  ENSP ID: ENSP00000466346
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKAVLSLYASGRTTGIVMDSGD

SEQ ID NO: 1460 - protein, 375 aa, Homo sapiens; identical to SEQ ID NO: 1449
  Payload ID: 426;
  Gene Symbol: ACTG1;
  Gene Name: actin gamma 1;
  Uniprot ID:  P63261;
  ENSP ID: ENSP00000477968

SEQ ID NO: 1461 - protein, 370 aa, Homo sapiens
  Payload ID: 427;
  Gene Symbol: ARPC1A;
  Gene Name: actin related prt 2/3 complex, subunit 1A, 41kDa;
  Uniprot ID:  Q92747;
  ENSP ID: ENSP00000262942
MSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSFSASGSRLAWVSHDSTVSVADASKSVQVSTLKTEFLPLLSVSFVSENSVVAAGHDCCPMLFNYDDRGCLTFVSKLDIPKQSIQRNMSAMERFRNMDKRATTEDRNTALETLHQNSITQVSIYEVDKQDCRKFCTTGIDGAMTIWDFKTLESSIQGLRIM

SEQ ID NO: 1462 - protein, 279 aa, Homo sapiens
  Payload ID: 427;
  Gene Symbol: ARPC1A;
  Gene Name: actin related prt 2/3 complex, subunit 1A, 41kDa;
  ENSP ID: ENSP00000408711
MSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSFSASGSRLAWVSHDSTVSVADASKSVQVSTLKTEFLPLLSVSFVSENSSCFRAMTAAQCSLTTMTAAA

SEQ ID NO: 1463 - protein, 53 aa, Homo sapiens
  Payload ID: 427;
  Gene Symbol: ARPC1A;
  Gene Name: actin related prt 2/3 complex, subunit 1A, 41kDa;
  ENSP ID: ENSP00000412879
MSLHQFLLEPITCHAWNRDRTRPVCLDYYSLVRLPSVPIITKCTSIRRTGASG

SEQ ID NO: 1464 - protein, 372 aa, Homo sapiens
  Payload ID: 428;
  Gene Symbol: ARPC1B;
  Gene Name: actin related prt 2/3 complex, subunit 1B, 41kDa;
  Uniprot ID:  O15143;
  ENSP ID: ENSP00000252725
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHGVCFSASGSRVAWVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 1465 - protein, 132 aa, Homo sapiens
  Payload ID: 428;
  Gene Symbol: ARPC1B;
  Gene Name: actin related prt 2/3 complex, subunit 1B, 41kDa;
  ENSP ID: ENSP00000388802
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWW

SEQ ID NO: 1466 - protein, 372 aa, Homo sapiens; identical to SEQ ID NO: 1464
  Payload ID: 428;
  Gene Symbol: ARPC1B;
  Gene Name: actin related prt 2/3 complex, subunit 1B, 41kDa;
  Uniprot ID:  O15143;
  ENSP ID: ENSP00000389631

SEQ ID NO: 1467 - protein, 132 aa, Homo sapiens; identical to SEQ ID NO: 1465
  Payload ID: 428;
  Gene Symbol: ARPC1B;
  Gene Name: actin related prt 2/3 complex, subunit 1B, 41kDa;
  ENSP ID: ENSP00000398110

SEQ ID NO: 1468 - protein, 102 aa, Homo sapiens
  Payload ID: 428;
  Gene Symbol: ARPC1B;
  Gene Name: actin related prt 2/3 complex, subunit 1B, 41kDa;
  ENSP ID: ENSP00000398620
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCV

SEQ ID NO: 1469 - protein, 130 aa, Homo sapiens
  Payload ID: 428;
  Gene Symbol: ARPC1B;
  Gene Name: actin related prt 2/3 complex, subunit 1B, 41kDa;
  ENSP ID: ENSP00000399955
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQEND

SEQ ID NO: 1470 - protein, 132 aa, Homo sapiens; identical to SEQ ID NO: 1465
  Payload ID: 428;
  Gene Symbol: ARPC1B;
  Gene Name: actin related prt 2/3 complex, subunit 1B, 41kDa;
  ENSP ID: ENSP00000403211

SEQ ID NO: 1471 - protein, 130 aa, Homo sapiens; identical to SEQ ID NO: 1469
  Payload ID: 428;
  Gene Symbol: ARPC1B;
  Gene Name: actin related prt 2/3 complex, subunit 1B, 41kDa;
  ENSP ID: ENSP00000403324

SEQ ID NO: 1472 - protein, 32 aa, Homo sapiens
  Payload ID: 428;
  Gene Symbol: ARPC1B;
  Gene Name: actin related prt 2/3 complex, subunit 1B, 41kDa;
  ENSP ID: ENSP00000408508
MAYHSFLVEPISCHAWNKDRTRQPVPGEDRVA

SEQ ID NO: 1473 - protein, 21 aa, Homo sapiens
  Payload ID: 428;
  Gene Symbol: ARPC1B;
  Gene Name: actin related prt 2/3 complex, subunit 1B, 41kDa;
  ENSP ID: ENSP00000408758
MAYHSFLVEPISCHAWNKDRT

SEQ ID NO: 1474 - protein, 128 aa, Homo sapiens
  Payload ID: 428;
  Gene Symbol: ARPC1B;
  Gene Name: actin related prt 2/3 complex, subunit 1B, 41kDa;
  ENSP ID: ENSP00000410238
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQE

SEQ ID NO: 1475 - protein, 82 aa, Homo sapiens
  Payload ID: 428;
  Gene Symbol: ARPC1B;
  Gene Name: actin related prt 2/3 complex, subunit 1B, 41kDa;
  ENSP ID: ENSP00000413067
MAYHSFLVEPISCHAWNKDRTQIAICPNNHEVHIYEKSGAKWTKVHELKEHNGQVTGIDWAPESNRIVTCGTDRNAYVWTLK

SEQ ID NO: 1476 - protein, 108 aa, Homo sapiens
  Payload ID: 428;
  Gene Symbol: ARPC1B;
  Gene Name: actin related prt 2/3 complex, subunit 1B, 41kDa;
  ENSP ID: ENSP00000413173
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNE

SEQ ID NO: 1477 - protein, 300 aa, Homo sapiens
  Payload ID: 429;
  Gene Symbol: ARPC2;
  Gene Name: actin related prt 2/3 complex, subunit 2, 34kDa;
  Uniprot ID:  O15144;
  ENSP ID: ENSP00000295685
MILLEVNNRIIEETLALKFENAAAGNKPEAVEVTFADFDGVLYHISNPNGDKTKVMVSISLKFYKELQAHGADELLKRVYGSFLVNPESGYNVSLLYDLENLPASKDSIVHQAGMLKRNCFASVFEKYFQFQEEGKEGENRAVIHYRDDETMYVESKKDRVTVVFSTVFKDDDDVVIGKVFMQEFKEGRRASHTAPQVLFSHREPPLELKDTDAAVGDNIGYITFVLFPRHTNASARDNTINLIHTFRDYLHYHIKCSKAYIHTRMRAKTSDFLKVLNRARPDAEKKEMKTITGKTFSSR

SEQ ID NO: 1478 - protein, 300 aa, Homo sapiens; identical to SEQ ID NO: 1477
  Payload ID: 429;
  Gene Symbol: ARPC2;
  Gene Name: actin related prt 2/3 complex, subunit 2, 34kDa;
  Uniprot ID:  O15144;
  ENSP ID: ENSP00000327137

SEQ ID NO: 1479 - protein, 91 aa, Homo sapiens
  Payload ID: 429;
  Gene Symbol: ARPC2;
  Gene Name: actin related prt 2/3 complex, subunit 2, 34kDa;
  ENSP ID: ENSP00000396475
MILLEVNNRIIEETLALKFENAAAGNKPEAVEVTFADFDGVLYHISNPNGDKTKVMVSISLKFYKELQAHGADELLKRVYGSFLVNPESVF

SEQ ID NO: 1480 - protein, 89 aa, Homo sapiens
  Payload ID: 429;
  Gene Symbol: ARPC2;
  Gene Name: actin related prt 2/3 complex, subunit 2, 34kDa;
  ENSP ID: ENSP00000401070
MILLEVNNRIIEETLALKFENAAAGNKPEAVEVTFADFDGVLYHISNPNGDKTKVMVSISLKFYKELQAHGADELLKRVYGSFLVNPES

SEQ ID NO: 1481 - protein, 165 aa, Homo sapiens
  Payload ID: 429;
  Gene Symbol: ARPC2;
  Gene Name: actin related prt 2/3 complex, subunit 2, 34kDa;
  ENSP ID: ENSP00000411612
KEGRRASHTAPQVLFSHREPPLELKDTDAAVGDNIGYITFVLFPRHTNASARDNTINLIHTFRDYLHYHIKCSKAYIHTRMRAKTSDFLKVLNRARPDAEKKEMKTITFSLAELGPRKEKQETNSCIHPENQIMLLMGEDVFIPLILGIRGGSGWQLKAGTLATG

SEQ ID NO: 1482 - protein, 38 aa, Homo sapiens
  Payload ID: 429;
  Gene Symbol: ARPC2;
  Gene Name: actin related prt 2/3 complex, subunit 2, 34kDa;
  ENSP ID: ENSP00000412632
MILLEVNNRIIEETLALKFENAAAGNKPEAVEVTFAGE

SEQ ID NO: 1483 - protein, 178 aa, Homo sapiens [sequence omitted]

SEQ ID NO: 1484 - protein, 99 aa, Homo sapiens
  Payload ID: 430;
  Gene Symbol: ARPC3;
  Gene Name: actin related prt 2/3 complex, subunit 3, 21kDa;
  ENSP ID: ENSP00000413221
MPAYHSSLMDPDTKLIGNMALLPIRSQFKGPAPRETKDTDIVDEAIYYFKANVFFKNYEIKNEADRTLIYITLYISECLKKLQKCNSKSQEVMRAYLQQ

SEQ ID NO: 1485 - protein, 84 aa, Homo sapiens
  Payload ID: 430;
  Gene Symbol: ARPC3;
  Gene Name: actin related prt 2/3 complex, subunit 3, 21kDa;
  ENSP ID: ENSP00000446598
MDPDTKLIGNMALLPIRSQFKGPAPRETKDTDIVDEAIYYFKANVFFKNYEIKNEADRTLIYITLYISECLKKLQKCNSKSQGE

SEQ ID NO: 1486 - protein, 168 aa, Homo sapiens
  Payload ID: 431;
  Gene Symbol: ARPC4;
  Gene Name: actin related prt 2/3 complex, subunit 4, 20kDa;
  Uniprot ID:  P59998;
  ENSP ID: ENSP00000380431
MTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNF

SEQ ID NO: 1487 - protein, 187 aa, Homo sapiens
  Payload ID: 431;
  Gene Symbol: ARPC4;
  Gene Name: actin related prt 2/3 complex, subunit 4, 20kDa;
  Uniprot ID:  P59998;
  ENSP ID: ENSP00000388169
MVREPGPRPGTPGCSASGQWTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNF

SEQ ID NO: 1488 - protein, 113 aa, Homo sapiens
  Payload ID: 431;
  Gene Symbol: ARPC4;
  Gene Name: actin related prt 2/3 complex, subunit 4, 20kDa;
  ENSP ID: ENSP00000395085
MTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEIIL

SEQ ID NO: 1489 - protein, 44 aa, Homo sapiens
  Payload ID: 431;
  Gene Symbol: ARPC4;
  Gene Name: actin related prt 2/3 complex, subunit 4, 20kDa;
  ENSP ID: ENSP00000414751
MTATLRPYLSAVRATLQAALCLENFSSQVVERHNKPEVEVSPRQ

SEQ ID NO: 1490 - protein, 78 aa, Homo sapiens
  Payload ID: 431;
  Gene Symbol: ARPC4;
  Gene Name: actin related prt 2/3 complex, subunit 4, 20kDa;
  Uniprot ID:  P59998;
  ENSP ID: ENSP00000432235
MRFMMMRAENFFILRRKPVEGYDISFLITNFHTEQMYKHKLVDFVIHFMEEIDKEISEMKLSVNARARIVAEEFLKNF

SEQ ID NO: 1491 - protein, 77 aa, Homo sapiens
  Payload ID: 431;
  Gene Symbol: ARPC4;
  Gene Name: actin related prt 2/3 complex, subunit 4, 20kDa;
  ENSP ID: ENSP00000473435
MRFMMMRAENFFILRRKPVEGYDISFLITNFHTEQMYKHKLVDFVIHFMEEIDKEISEMKLSVNARARIVAEEFLKN

SEQ ID NO: 1492 - protein, 154 aa, Homo sapiens
  Payload ID: 432;
  Gene Symbol: ARPC5;
  Gene Name: actin related prt 2/3 complex, subunit 5, 16kDa;
  Uniprot ID:  O15511;
  ENSP ID: ENSP00000294742
MSKNTVSSARFRKVDVDEYDENKFVDEEDGGDGQAGPDEGEVDSCLRHSITGNMTAALQAALKNPPINTKSQAVKDRAGSIVLKVLISFKANDIEKAVQSLDKNGVDLLMKYIYKGFESPSDNSSAMLLQWHEKALAAGGVGSIVRVLTARKTV

SEQ ID NO: 1493 - protein, 151 aa, Homo sapiens
  Payload ID: 432;
  Gene Symbol: ARPC5;
  Gene Name: actin related prt 2/3 complex, subunit 5, 16kDa;
  Uniprot ID:  O15511;
  ENSP ID: ENSP00000352918
MSKNTVSSARFRKVDVDEYDENKFVDEEDGGDGQAGPDEGEVDSCLRQGNMTAALQAALKNPPINTKSQAVKDRAGSIVLKVLISFKANDIEKAVQSLDKNGVDLLMKYIYKGFESPSDNSSAMLLQWHEKALAAGGVGSIVRVLTARKTV

SEQ ID NO: 1494 - protein, 135 aa, Homo sapiens
  Payload ID: 432;
  Gene Symbol: ARPC5;
  Gene Name: actin related prt 2/3 complex, subunit 5, 16kDa;
  ENSP ID: ENSP00000356504
MSKNTVSSARFRKVDVDEYDENKFVDEEDGGDGQAGPDEGEVDSCLRQGNMTAALQAALKNPPINTKSQAVKDRAGSIVLKVLISFKANDIEKAVQSLDKNGVDLLMKYIYKGFESPSDNSSAMLLQWHEKVPLV

SEQ ID NO: 1495 - protein, 153 aa, Homo sapiens
  Payload ID: 433;
  Gene Symbol: ARPC5L;
  Gene Name: actin related prt 2/3 complex, subunit 5-like;
  Uniprot ID:  Q9BPX5;
  ENSP ID: ENSP00000259477
MARNTLSSRFRRVDIDEFDENKFVDEQEEAAAAAAEPGPDPSEVDGLLRQGDMLRAFHAALRNSPVNTKNQAVKERAQGVVLKVLTNFKSSEIEQAVQSLDRNGVDLLMKYIYKGFEKPTENSSAVLLQWHEKALAVGGLGSIIRVLTARKTV

SEQ ID NO: 1496 - protein, 153 aa, Homo sapiens; identical to SEQ ID NO: 1495
  Payload ID: 433;
  Gene Symbol: ARPC5L;
  Gene Name: actin related prt 2/3 complex, subunit 5-like;
  Uniprot ID:  Q9BPX5;
  ENSP ID: ENSP00000345361

SEQ ID NO: 1497 - protein, 254 aa, Homo sapiens
  Payload ID: 434;
  Gene Symbol: ACTA1;
  Gene Name: actin, alpha 1, skeletal muscle;
  ENSP ID: ENSP00000355644
MCDEDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 1498 - protein, 377 aa, Homo sapiens
  Payload ID: 434;
  Gene Symbol: ACTA1;
  Gene Name: actin, alpha 1, skeletal muscle;
  Uniprot ID:  P68133;
  ENSP ID: ENSP00000355645
MCDEDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 1499 - protein, 377 aa, Homo sapiens
  Payload ID: 435;
  Gene Symbol: ACTA2;
  Gene Name: actin, alpha 2, smooth muscle, aorta;
  Uniprot ID:  P62736;
  ENSP ID: ENSP00000224784
MCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 1500 - protein, 151 aa, Homo sapiens
  Payload ID: 435;
  Gene Symbol: ACTA2;
  Gene Name: actin, alpha 2, smooth muscle, aorta;
  ENSP ID: ENSP00000396730
MCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTT

SEQ ID NO: 1501 - protein, 151 aa, Homo sapiens; identical to SEQ ID NO: 1500
  Payload ID: 435;
  Gene Symbol: ACTA2;
  Gene Name: actin, alpha 2, smooth muscle, aorta;
  ENSP ID: ENSP00000398239

SEQ ID NO: 1502 - protein, 377 aa, Homo sapiens; identical to SEQ ID NO: 1499
  Payload ID: 435;
  Gene Symbol: ACTA2;
  Gene Name: actin, alpha 2, smooth muscle, aorta;
  Uniprot ID:  P62736;
  ENSP ID: ENSP00000402373

SEQ ID NO: 1503 - protein, 377 aa, Homo sapiens
  Payload ID: 436;
  Gene Symbol: ACTC1;
  Gene Name: actin, alpha, cardiac muscle 1;
  Uniprot ID:  P68032;
  ENSP ID: ENSP00000290378
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 1504 - protein, 375 aa, Homo sapiens
  Payload ID: 437;
  Gene Symbol: ACTB;
  Gene Name: actin, beta;
  Uniprot ID:  P60709;
  ENSP ID: ENSP00000349960
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 1505 - protein, 102 aa, Homo sapiens
  Payload ID: 437;
  Gene Symbol: ACTB;
  Gene Name: actin, beta;
  ENSP ID: ENSP00000393951
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHP

SEQ ID NO: 1506 - protein, 99 aa, Homo sapiens
  Payload ID: 437;
  Gene Symbol: ACTB;
  Gene Name: actin, beta;
  ENSP ID: ENSP00000399487
MLTMDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRV

SEQ ID NO: 1507 - protein, 80 aa, Homo sapiens
  Payload ID: 437;
  Gene Symbol: ACTB;
  Gene Name: actin, beta;
  ENSP ID: ENSP00000401032
MDDDIAALVVDNGSGMCKAGFAGDDAPRAVFPSIVGRPRHQGVMVGMGQKDSYVGDEAQSKRGILTLKYPIEHGIVTNWD

SEQ ID NO: 1508 - protein, 163 aa, Homo sapiens
  Payload ID: 437;
  Gene Symbol: ACTB;
  Gene Name: actin, beta;
  ENSP ID: ENSP00000407473
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTV

SEQ ID NO: 1509 - protein, 125 aa, Homo sapiens
  Payload ID: 437;
  Gene Symbol: ACTB;
  Gene Name: actin, beta;
  ENSP ID: ENSP00000409264
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQDSLL

SEQ ID NO: 1510 - protein, 376 aa, Homo sapiens
  Payload ID: 438;
  Gene Symbol: ACTBL2;
  Gene Name: actin, beta-like 2;
  Uniprot ID:  Q562R1;
  ENSP ID: ENSP00000416706
MTDNELSALVVDNGSGMCKAGFGGDDAPRAVFPSMIGRPRHQGVMVGMGQKDCYVGDEAQSKRGVLTLKYPIEHGVVTNWDDMEKIWYHTFYNELRVAPDEHPILLTEAPLNPKINREKMTQIMFEAFNTPAMYVAIQAVLSLYASGRTTGIVMDSGDGVTHIVPIYEGYALPHAILRLDLAGRDLTDYLMKILTERGYNFTTTAEREIVRDVKEKLCYVALDFEQEMVRAAASSSPERSYELPDGQVITIGNERFRCPEAIFQPSFLGIESSGIHETTFNSIMKCDVDIRKDLYANTVLSGGSTMYPGIADRMQKEIITLAPSTMKIKIIAPPERKYSVWIGGSILASLSTFQQMWISKQEYDEAGPPIVHRKCF

SEQ ID NO: 1511 - protein, 376 aa, Homo sapiens
  Payload ID: 439;
  Gene Symbol: ACTG2;
  Gene Name: actin, gamma 2, smooth muscle, enteric;
  Uniprot ID:  P63267;
  ENSP ID: ENSP00000295137
MCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 1512 - protein, 376 aa, Homo sapiens; identical to SEQ ID NO: 1511
  Payload ID: 439;
  Gene Symbol: ACTG2;
  Gene Name: actin, gamma 2, smooth muscle, enteric;
  Uniprot ID:  P63267;
  ENSP ID: ENSP00000386857

SEQ ID NO: 1513 - protein, 333 aa, Homo sapiens
  Payload ID: 439;
  Gene Symbol: ACTG2;
  Gene Name: actin, gamma 2, smooth muscle, enteric;
  Uniprot ID:  P63267;
  ENSP ID: ENSP00000386929
MCEEETTALVCDNGSGLCKAGFAGDDAPRAVFPSIVGRPRHQIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 1514 - protein, 119 aa, Homo sapiens
  Payload ID: 439;
  Gene Symbol: ACTG2;
  Gene Name: actin, gamma 2, smooth muscle, enteric;
  ENSP ID: ENSP00000387182
MCEEETTALVCDNGSGLCKAGFAGDDAPRAVFPSIVGRPRHQGVMVGMGQKDSYVGDEAQSKRGILTLKYPIEHGIITNWDDMEKPHDHFSNLGCQHLSLDYCNGFLADFLVSCPHSPN

SEQ ID NO: 1515 - protein, 52 aa, Homo sapiens
  Payload ID: 439;
  Gene Symbol: ACTG2;
  Gene Name: actin, gamma 2, smooth muscle, enteric;
  ENSP ID: ENSP00000392894
MCEEETTALVCDNGSGLCKAGFAGDDAPRAVFPSIVGRPRHQVRAHLDTTRL

SEQ ID NO: 1516 - protein, 144 aa, Homo sapiens
  Payload ID: 439;
  Gene Symbol: ACTG2;
  Gene Name: actin, gamma 2, smooth muscle, enteric;
  ENSP ID: ENSP00000410020
MCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQVRSQEDLNTGIRMQHGCLARYF

SEQ ID NO: 1517 - protein, 105 aa, Homo sapiens
  Payload ID: 439;
  Gene Symbol: ACTG2;
  Gene Name: actin, gamma 2, smooth muscle, enteric;
  ENSP ID: ENSP00000410706
MCEEETTALVCDNGSGLCKAGFAGDDAPRAVFPSIVGRPRHQGVMVGMGQKDSYVGDEAQSKRGILTLKYPIEHGIITNWDDMEKPLAGIFYQPNIARSQKAMNT

SEQ ID NO: 1518 - protein, 892 aa, Homo sapiens
  Payload ID: 440;
  Gene Symbol: ACTN1;
  Gene Name: actinin, alpha 1;
  Uniprot ID:  P12814;
  ENSP ID: ENSP00000193403
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 1519 - protein, 822 aa, Homo sapiens
  Payload ID: 440;
  Gene Symbol: ACTN1;
  Gene Name: actinin, alpha 1;
  ENSP ID: ENSP00000366035
MLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRKKTGMMDTDDFRACLISMGYNMGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 1520 - protein, 914 aa, Homo sapiens
  Payload ID: 440;
  Gene Symbol: ACTN1;
  Gene Name: actinin, alpha 1;
  Uniprot ID:  P12814;
  ENSP ID: ENSP00000377941
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQKKTGMMDTDDFRACLISMGYNMGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 1521 - protein, 887 aa, Homo sapiens
  Payload ID: 440;
  Gene Symbol: ACTN1;
  Gene Name: actinin, alpha 1;
  Uniprot ID:  P12814;
  ENSP ID: ENSP00000414272
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRKKTGMMDTDDFRACLISMGYNMGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 1522 - protein, 930 aa, Homo sapiens
  Payload ID: 440;
  Gene Symbol: ACTN1;
  Gene Name: actinin, alpha 1;
  Uniprot ID:  P12814;
  ENSP ID: ENSP00000439828
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRKKTGMMDTDDFRACLISMGYNMGEAEFARIMSIVDPNRLGVVTFQAFIDFMSRETADTDTADQVMASFKILAGDKLQEGGKMQTAHAAFTPPGFAAVSGRAALRLLDFAAFLTTLSSQNYITMDELRRELPPDQAEYCIARMAPYTGPDSVPGALDYMSFSTALYGESDL

SEQ ID NO: 1523 - protein, 297 aa, Homo sapiens
  Payload ID: 440;
  Gene Symbol: ACTN1;
  Gene Name: actinin, alpha 1;
  ENSP ID: ENSP00000444422
DGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGP

SEQ ID NO: 1524 - protein, 85 aa, Homo sapiens
  Payload ID: 440;
  Gene Symbol: ACTN1;
  Gene Name: actinin, alpha 1;
  ENSP ID: ENSP00000450618
MLLLEVISGERLAKPERGKMRVHKISNVNKALDFIASKGVKLVSIGAEEIVDGNVKMTLGMIWTIILRFAIQDISVEETSAKEGL

SEQ ID NO: 1525 - protein, 207 aa, Homo sapiens
  Payload ID: 440;
  Gene Symbol: ACTN1;
  Gene Name: actinin, alpha 1;
  ENSP ID: ENSP00000450625
  MOD_RES (1)..(1): Any amino acid
XEKLLETIDQLYLEYAKRAAPFNNWMEGAMEDLQDTFIVHTIEEIQVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLG

SEQ ID NO: 1526 - protein, 260 aa, Homo sapiens
  Payload ID: 440;
  Gene Symbol: ACTN1;
  Gene Name: actinin, alpha 1;
  ENSP ID: ENSP00000450764
MGLRYVLPLRPPGKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEK

SEQ ID NO: 1527 - protein, 238 aa, Homo sapiens
  Payload ID: 440;
  Gene Symbol: ACTN1;
  Gene Name: actinin, alpha 1;
  ENSP ID: ENSP00000450903
MLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPE

SEQ ID NO: 1528 - protein, 144 aa, Homo sapiens
  Payload ID: 440;
  Gene Symbol: ACTN1;
  Gene Name: actinin, alpha 1;
  ENSP ID: ENSP00000450925
MLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAF

SEQ ID NO: 1529 - protein, 72 aa, Homo sapiens
  Payload ID: 440;
  Gene Symbol: ACTN1;
  Gene Name: actinin, alpha 1;
  ENSP ID: ENSP00000451086
MGPGHSGQWQEEVRNHSWWWGEGASTLPLLPACATFTAWCNSHLRKAGTQIENIEEDFRDGLKLMLLLEVIS

SEQ ID NO: 1530 - protein, 251 aa, Homo sapiens
  Payload ID: 440;
  Gene Symbol: ACTN1;
  Gene Name: actinin, alpha 1;
  ENSP ID: ENSP00000452254
  MOD_RES (1)..(1): Any amino acid
XQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 1531 - protein, 126 aa, Homo sapiens
  Payload ID: 440;
  Gene Symbol: ACTN1;
  Gene Name: actinin, alpha 1;
  ENSP ID: ENSP00000452423
MGPGHSGQWQEETFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEG

SEQ ID NO: 1532 - protein, 894 aa, Homo sapiens
  Payload ID: 441;
  Gene Symbol: ACTN2;
  Gene Name: actinin, alpha 2;
  Uniprot ID:  P35609;
  ENSP ID: ENSP00000355537
MNQIEPGVQYNYVYDEDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDIVNTPKPDERAIMTYVSCFYHAFAGAEQAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 1533 - protein, 686 aa, Homo sapiens
  Payload ID: 441;
  Gene Symbol: ACTN2;
  Gene Name: actinin, alpha 2;
  ENSP ID: ENSP00000438384
MTYVSCFYHAFAGAEQVRQSLKAHSALWKDPPPESSTCSYQEMRRSSVNSSAMAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 1534 - protein, 894 aa, Homo sapiens
  Payload ID: 441;
  Gene Symbol: ACTN2;
  Gene Name: actinin, alpha 2;
  Uniprot ID:  P35609;
  ENSP ID: ENSP00000443495
MNQIEPGVQYNYVYDEDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDLVYTARPDERAIMTYVSCYYHAFAGAQKAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 1535 - protein, 944 aa, Homo sapiens
  Payload ID: 442;
  Gene Symbol: ACTN3;
  Gene Name: actinin, alpha 3 ( gene/pseudogene);
  ENSP ID: ENSP00000422007
MGIGLCVPPARCWKRLTRSSRGQPLERPAATIIIGLSIVERSKQTQRGPVDFSRSHSAPAAEQECKPRISAARSTPAPPSPAVPGFRTTPCQTFTAWCNSHLRKAGTQIENIEEDFRNGLKLMLLLEVISGERLPRPDKGKMRFHKIANVNKALDFIASKGVKLVSIGAEEIVDGNLKMTLGMIWTIILRFAIQDISVEETSAKEGLLLWCQRKTAPYRNVNVQNFHTSWKDGLALCALIHRHRPDLIDYAKLRKDDPIGNLNTAFEVAEKYLDIPKMLDAEDIVNTPKPDEKAIMTYVSCFYHAFAGAEQAETAANRICKVLAVNQENEKLMEEYEKLASELLEWIRRTVPWLENRVGEPSMSAMQRKLEDFRDYRRLHKPPRIQEKCQLEINFNTLQTKLRLSHRPAFMPSEGKLVSDIANAWRGLEQVEKGYEDWLLSEIRRLQRLQHLAEKFRQKASLHEAWTRGKEEMLSQRDYDSALLQEVRALLRRHEAFESDLAAHQDRVEHIAALAQELNELDYHEAASVNSRCQAICDQWDNLGTLTQKRRDALERMEKLLETIDRLQLEFARRAAPFNNWLDGAVEDLQDVWLVHSVEETQSLLTAHDQFKATLPEADRERGAIMGIQGEIQKICQTYGLRPCSTNPYITLSPQDINTKWDMVRKLVPSCDQTLQEELARQQVNERLRRQFAAQANAIGPWIQAKVEEVGRLAAGLAGSLEEQMAGLRQQEQNIINYKTNIDRLEGDHQLLQESLVFDNKHTVYSMEHIRVGWEQLLTSIARTINEVENQVLTRDAKGLSQEQLNEFRASFNHFDRKQNGMMEPDDFRACLISMGYDLGEVEFARIMTMVDPNAAGVVTFQAFIDFMTRETAETDTTEQVVASFKILAGDKNYITPEELRRELPAKQAEYCIRRMVPYKGSGAPAGALDYVAFSSALYGESDL

SEQ ID NO: 1536 - protein, 72 aa, Homo sapiens
  Payload ID: 442;
  Gene Symbol: ACTN3;
  Gene Name: actinin, alpha 3 ( gene/pseudogene);
  ENSP ID: ENSP00000426236
MMMVMQPEGLGAGEGRFAGGGGGGEYMEQEEDWDRDLLLDPAWEKQQRKENESSERERDWPRMHSKSVAELS

SEQ ID NO: 1537 - protein, 901 aa, Homo sapiens
  Payload ID: 442;
  Gene Symbol: ACTN3;
  Gene Name: actinin, alpha 3 ( gene/pseudogene);
  Uniprot ID:  Q08043;
  ENSP ID: ENSP00000426797
MMMVMQPEGLGAGEGRFAGGGGGGEYMEQEEDWDRDLLLDPAWEKQQRKTFTAWCNSHLRKAGTQIENIEEDFRNGLKLMLLLEVISGERLPRPDKGKMRFHKIANVNKALDFIASKGVKLVSIGAEEIVDGNLKMTLGMIWTIILRFAIQDISVEETSAKEGLLLWCQRKTAPYRNVNVQNFHTSWKDGLALCALIHRHRPDLIDYAKLRKDDPIGNLNTAFEVAEKYLDIPKMLDAEDIVNTPKPDEKAIMTYVSCFYHAFAGAEQAETAANRICKVLAVNQENEKLMEEYEKLASELLEWIRRTVPWLENRVGEPSMSAMQRKLEDFRDYRRLHKPPRIQEKCQLEINFNTLQTKLRLSHRPAFMPSEGKLVSDIANAWRGLEQVEKGYEDWLLSEIRRLQRLQHLAEKFRQKASLHEAWTRGKEEMLSQRDYDSALLQEVRALLRRHEAFESDLAAHQDRVEHIAALAQELNELDYHEAASVNSRCQAICDQWDNLGTLTQKRRDALERMEKLLETIDRLQLEFARRAAPFNNWLDGAVEDLQDVWLVHSVEETQSLLTAHDQFKATLPEADRERGAIMGIQGEIQKICQTYGLRPCSTNPYITLSPQDINTKWDMVRKLVPSCDQTLQEELARQQVNERLRRQFAAQANAIGPWIQAKVEEVGRLAAGLAGSLEEQMAGLRQQEQNIINYKTNIDRLEGDHQLLQESLVFDNKHTVYSMEHIRVGWEQLLTSIARTINEVENQVLTRDAKGLSQEQLNEFRASFNHFDRKQNGMMEPDDFRACLISMGYDLGEVEFARIMTMVDPNAAGVVTFQAFIDFMTRETAETDTTEQVVASFKILAGDKNYITPEELRRELPAKQAEYCIRRMVPYKGSGAPAGALDYVAFSSALYGESDL

SEQ ID NO: 1538 - protein, 911 aa, Homo sapiens
  Payload ID: 443;
  Gene Symbol: ACTN4;
  Gene Name: actinin, alpha 4;
  Uniprot ID:  O43707;
  ENSP ID: ENSP00000252699
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 1539 - protein, 342 aa, Homo sapiens
  Payload ID: 443;
  Gene Symbol: ACTN4;
  Gene Name: actinin, alpha 4;
  ENSP ID: ENSP00000398393
GLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKKQTGSMDSDDFRALLISTGYSLGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 1540 - protein, 521 aa, Homo sapiens
  Payload ID: 443;
  Gene Symbol: ACTN4;
  Gene Name: actinin, alpha 4;
  ENSP ID: ENSP00000411187
MVDYHAANQSYQYGPSSAGNGAGGGGSMGDYMAQEDDWDRDLLLDPAWEKQQRKTFTAWCNSHLRKAGTQIENIDEDFRDGLKLMLLLEVIELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 1541 - protein, 692 aa, Homo sapiens
  Payload ID: 443;
  Gene Symbol: ACTN4;
  Gene Name: actinin, alpha 4;
  Uniprot ID:  O43707;
  ENSP ID: ENSP00000439497
MVDYHAANQSYQYGPSSAGNGAGGGGSMGDYMAQEDDWDRDLLLDPAWEKQQRKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 1542 - protein, 182 aa, Homo sapiens
  Payload ID: 443;
  Gene Symbol: ACTN4;
  Gene Name: actinin, alpha 4;
  ENSP ID: ENSP00000465176
ALIHRHRPELIEYDKLRKDDPVTNLNNAFEVAEKYLDIPKMLDAEDIVGTLRPDEKAIMTYVSCFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVS

SEQ ID NO: 1543 - protein, 105 aa, Homo sapiens
  Payload ID: 443;
  Gene Symbol: ACTN4;
  Gene Name: actinin, alpha 4;
  ENSP ID: ENSP00000467190
  MOD_RES (1)..(1): Any amino acid
XGGMVDYHAANQSYQYGPSSAGNGAGGGGSMGDYMAQEDDWDRDLLLDPAWEKQQRKTFTAWCNSHLRKAGTQIENIDEDFRDGLKLMLLLEVISEELSWQTGPP

SEQ ID NO: 1544 - protein, 692 aa, Homo sapiens; identical to SEQ ID NO: 1541
  Payload ID: 443;
  Gene Symbol: ACTN4;
  Gene Name: actinin, alpha 4;
  ENSP ID: ENSP00000488962

SEQ ID NO: 1545 - protein, 105 aa, Homo sapiens; identical to SEQ ID NO: 1543
  Payload ID: 443;
  Gene Symbol: ACTN4;
  Gene Name: actinin, alpha 4;
  ENSP ID: ENSP00000489202
  MOD_RES (1)..(1): Any amino acid

SEQ ID NO: 1546 - protein, 911 aa, Homo sapiens; identical to SEQ ID NO: 1538
  Payload ID: 443;
  Gene Symbol: ACTN4;
  Gene Name: actinin, alpha 4;
  ENSP ID: ENSP00000489220

SEQ ID NO: 1547 - protein, 342 aa, Homo sapiens; identical to SEQ ID NO: 1539
  Payload ID: 443;
  Gene Symbol: ACTN4;
  Gene Name: actinin, alpha 4;
  ENSP ID: ENSP00000489448

SEQ ID NO: 1548 - protein, 521 aa, Homo sapiens; identical to SEQ ID NO: 1540
  Payload ID: 443;
  Gene Symbol: ACTN4;
  Gene Name: actinin, alpha 4;
  ENSP ID: ENSP00000489474

SEQ ID NO: 1549 - protein, 182 aa, Homo sapiens; identical to SEQ ID NO: 1542
  Payload ID: 443;
  Gene Symbol: ACTN4;
  Gene Name: actinin, alpha 4;
  ENSP ID: ENSP00000489516

SEQ ID NO: 1550 - protein, 245 aa, Homo sapiens
  Payload ID: 444;
  Gene Symbol: ACTL10;
  Gene Name: actin-like 10;
  Uniprot ID:  Q5JWF8;
  ENSP ID: ENSP00000329647
MASTALLALCSTGAFSGLAVEAGAGVCHATPIYAGHSWHQATFRLNVAGSTLSRYLRDLLVAANPDLLQQALPRKAITHLKKRSCYVSLDFEGDLRDPARHHPASFSVGNGCCVCLSSERFRCPEPIFQPGLLGQAEQGLPALAFRALQKMPKTLRTRLADTVVLAGGSTLFPGFAERLDKELEAQCRRHGYAALRPHLVAKHGRGMAVWTGGSMVASLHSFQRRWITRAMYQECGSRLLYDVFN

SEQ ID NO: 1551 - protein, 387 aa, Homo sapiens
  Payload ID: 445;
  Gene Symbol: ACTL6A;
  Gene Name: actin-like 6A;
  Uniprot ID:  O96019;
  ENSP ID: ENSP00000376430
MVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 1552 - protein, 387 aa, Homo sapiens; identical to SEQ ID NO: 1551
  Payload ID: 445;
  Gene Symbol: ACTL6A;
  Gene Name: actin-like 6A;
  Uniprot ID:  O96019;
  ENSP ID: ENSP00000394014

SEQ ID NO: 1553 - protein, 429 aa, Homo sapiens
  Payload ID: 445;
  Gene Symbol: ACTL6A;
  Gene Name: actin-like 6A;
  Uniprot ID:  O96019;
  ENSP ID: ENSP00000397552
MSGGVYGGDEVGALVFDIGSYTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 1554 - protein, 50 aa, Homo sapiens
  Payload ID: 445;
  Gene Symbol: ACTL6A;
  Gene Name: actin-like 6A;
  ENSP ID: ENSP00000420153
MVVERDDGSTLMEIDGDKGKQGGPTYYIDTNALRVPRENMEAISPLKNGM

SEQ ID NO: 1555 - protein, 161 aa, Homo sapiens
  Payload ID: 445;
  Gene Symbol: ACTL6A;
  Gene Name: actin-like 6A;
  ENSP ID: ENSP00000420694
  MOD_RES (1)..(1): Any amino acid
XFSDEVGALVFDIGSYTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFIHHLLH

SEQ ID NO: 1556 - protein, 426 aa, Homo sapiens
  Payload ID: 446;
  Gene Symbol: ACTL6B;
  Gene Name: actin-like 6B;
  Uniprot ID:  O94805;
  ENSP ID: ENSP00000160382
MSGGVYGGDEVGALVFDIGSFSVRAGYAGEDCPKADFPTTVGLLAAEEGGGLELEGDKEKKGKIFHIDTNALHVPRDGAEVMSPLKNGMIEDWECFRAILDHTYSKHVKSEPNLHPVLMSEAPWNTRAKREKLTELMFEQYNIPAFFLCKTAVLTAFANGRSTGLVLDSGATHTTAIPVHDGYVLQQGIVKSPLAGDFISMQCRELFQEMAIDIIPPYMIAAKEPVREGAPPNWKKKEKLPQVSKSWHNYMCNEVIQDFQASVLQVSDSPYDEQVAAQMPTVHYEMPNGYNTDYGAERLRIPEGLFDPSNVKGLSGNTMLGVGHVVTTSIGMCDIDIRPGLYGSVIVTGGNTLLQGFTDRLNRELSQKTPPSMRLKLIASNSTMERKFSPWIGGSILASLGTFQQMWISKQEYEEGGKQCVERKCP

SEQ ID NO: 1557 - protein, 66 aa, Homo sapiens
  Payload ID: 446;
  Gene Symbol: ACTL6B;
  Gene Name: actin-like 6B;
  ENSP ID: ENSP00000420151
MSPLKNGMIEDWECFRAILDHTYSKHVKSEPNLHPVLMSEAPWNTRAKREKLTELMFEQYNIPAFF

SEQ ID NO: 1558 - protein, 435 aa, Homo sapiens
  Payload ID: 447;
  Gene Symbol: ACTL7A;
  Gene Name: actin-like 7A;
  Uniprot ID:  Q9Y615;
  ENSP ID: ENSP00000334300
MWAPPAAIMGDGPTKKVGNQAPLQTQALQTASLRDGPAKRAVWVRHTSSEPQEPTESKAAKERPKQEVTKAVVVDLGTGYCKCGFAGLPRPTHKISTTVGKPYMETAKTGDNRKETFVGQELNNTNVHLKLVNPLRHGIIVDWDTVQDIWEYLFRQEMKIAPEEHAVLVSDPPLSPHTNREKYAEMLFEAFNTPAMHIAYQSRLSMYSYGRTSGLVVEVGHGVSYVVPIYEGYPLPSITGRLDYAGSDLTAYLLGLLNSAGNEFTQDQMGIVEDIKKKCCFVALDPIEEKKVPLSEHTIRYVLPDGKEIQLCQERFLCSEMFFKPSLIKSMQLGLHTQTVSCLNKCDIALKRDLMGNILLCGGSTMLSGFPNRLQKELSSMCPNDTPQVNVLPERDSAVWTGGSILASLQGFQPLWVHRFEYEEHGPFFLYRRCF

SEQ ID NO: 1559 - protein, 415 aa, Homo sapiens
  Payload ID: 448;
  Gene Symbol: ACTL7B;
  Gene Name: actin-like 7B;
  Uniprot ID:  Q9Y614;
  ENSP ID: ENSP00000363799
MATRNSPMPLGTAQGDPGEAGTRPGPDASLRDTGAATQLKMKPRKVHKIKAVIIDLGSQYCKCGYAGEPRPTYFISSTVGKRCPEAADAGDTRKWTLVGHELLNTEAPLKLVNPLKHGIVVDWDCVQDIWEYIFRTAMKILPEEHAVLVSDPPLSPSSNREKYAELMFETFGIPAMHVTSQSLLSIYSYGKTSGLVVESGHGVSHVVPISEGDVLPGLTSRADYAGGDLTNYLMQLLNEAGHAFTDDHLHIIEHIKKKCCYAAFLPEEELGLVPEELRVDYELPDGKLITIGQERFRCSEMLFQPSLAGSTQPGLPELTAACLGRCQDTGFKEEMAANVLLCGGCTMLDGFPERFQRELSLLCPGDSPAVAAAPERKTSVWTGGSILASLQAFQQLWVSKEEFEERGSVAIYSKC

SEQ ID NO: 1560 - protein, 366 aa, Homo sapiens
  Payload ID: 449;
  Gene Symbol: ACTL8;
  Gene Name: actin-like 8;
  Uniprot ID:  Q9H568;
  ENSP ID: ENSP00000364555
MAARTVIIDHGSGFLKAGTAGWNEPQMVFPNIVNYLPCKENPGPSYARRRVSLGIDICHPDTFSYPIERGRILNWEGVQYLWSFVLENHRREQEVPPVIITETPLREPADRKKMLEILFELLHVPSVLLADQLQMSLYASGLLTGVVVDSGYGLTRVQPFHQGRPLPASGKTLEFAGQDLSAYLLKSLFKEDCDRRCLFQLETVAVTQMNKCYVPQNLGEALDFRERQQSALDESNTYQLPDGSRVELTPMQRVAPEMFFSPQVFEQPGPSIPRAIVESVESCEISLRPLLVSHVMACGGNTLYPGFTKRLFRELMGDHVSSTKATVWEGSNRNFSVWLGASVVAHLSTYQSEWMSREEYGEHMRM

SEQ ID NO: 1561 - protein, 366 aa, Homo sapiens; identical to SEQ ID NO: 1560
  Payload ID: 449;
  Gene Symbol: ACTL8;
  Gene Name: actin-like 8;
  Uniprot ID:  Q9H568;
  ENSP ID: ENSP00000481590

SEQ ID NO: 1562 - protein, 416 aa, Homo sapiens
  Payload ID: 450;
  Gene Symbol: ACTL9;
  Gene Name: actin-like 9;
  Uniprot ID:  Q8TC94;
  ENSP ID: ENSP00000316674
MDASRPKSSESQSSLEAPRPGPNPSPNVVNKPLQRDSPGMVADRLPPKTGAVVIDMGTGTCKVGFAGQASPTYTVATILGCQPKKPATSGQSGLQTFIGEAARVLPELTLVQPLRSGIVVDWDAAELIWRHLLEHDLRVATHDHPLLFSDPPFSPATNREKLVEVAFESLRSPAMYVASQSVLSVYAHGRVSGLVVDTGHGVTYTVPVFQGYNLLHATERLDLAGNNLTAFLAEMLLQAGLPLGQQDLDLVENIKHHYCYVASDFQKEQARPEQEYKRTLKLPDGRTVTLGKELFQCPELLFNPPEVPGLSPVGLSTMAKQSLRKLSLEMRADLAQNVLLCGGSSLFTGFEGRFRAELLRALPAETHVVVAAQPTRNFSVWIGGSILASLRAFQSCWVLREQYEEQGPYIVYRKCY

SEQ ID NO: 1563 - protein, 416 aa, Homo sapiens; identical to SEQ ID NO: 1562
  Payload ID: 450;
  Gene Symbol: ACTL9;
  Gene Name: actin-like 9;
  Uniprot ID:  Q8TC94;
  ENSP ID: ENSP00000482603

SEQ ID NO: 1564 - protein, 417 aa, Homo sapiens
  Payload ID: 451;
  Gene Symbol: ACTR10;
  Gene Name: actin-related prt 10 homolog (S. cerevisiae);
  Uniprot ID:  Q9NZ32;
  ENSP ID: ENSP00000254286
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPPNVDYPLDGEKILHILGSIRDSVVEILFEQDNEEQSVATLILDSLIQCPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 1565 - protein, 185 aa, Homo sapiens
  Payload ID: 451;
  Gene Symbol: ACTR10;
  Gene Name: actin-related prt 10 homolog (S. cerevisiae);
  ENSP ID: ENSP00000438183
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVLPISFLNPSSKLLGSTTPRRKSSSQRVGNSTIGTMYC

SEQ ID NO: 1566 - protein, 126 aa, Homo sapiens
  Payload ID: 451;
  Gene Symbol: ACTR10;
  Gene Name: actin-related prt 10 homolog (S. cerevisiae);
  ENSP ID: ENSP00000450796
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFERVGNSTIGTMYC

SEQ ID NO: 1567 - protein, 149 aa, Homo sapiens
  Payload ID: 451;
  Gene Symbol: ACTR10;
  Gene Name: actin-related prt 10 homolog (S. cerevisiae);
  ENSP ID: ENSP00000451289
  MOD_RES (1)..(1): Any amino acid
XSDLKRGLKIQAAKFNIDGNNECPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 1568 - protein, 35 aa, Homo sapiens
  Payload ID: 451;
  Gene Symbol: ACTR10;
  Gene Name: actin-related prt 10 homolog (S. cerevisiae);
  ENSP ID: ENSP00000451336
  MOD_RES (1)..(1): Any amino acid
XRTCFVSDLKRGLKIQAAKFNIDGNNERFSCGNSF

SEQ ID NO: 1569 - protein, 43 aa, Homo sapiens
  Payload ID: 451;
  Gene Symbol: ACTR10;
  Gene Name: actin-related prt 10 homolog (S. cerevisiae);
  ENSP ID: ENSP00000451863
MPLYEGLGSGGEKTAVVIDLGEAFTNLSELFSIISIQKNYIPT

SEQ ID NO: 1570 - protein, 90 aa, Homo sapiens
  Payload ID: 451;
  Gene Symbol: ACTR10;
  Gene Name: actin-related prt 10 homolog (S. cerevisiae);
  ENSP ID: ENSP00000452135
MPLYEGLGSGGEKTAVVIDLGEAFTKCGFAGETGPRCIIPSVIKRAGMPKVLTLSPRLECSGTILAHCNLCLPATSTSWVQAVLPLQPPE

SEQ ID NO: 1571 - protein, 179 aa, Homo sapiens
  Payload ID: 451;
  Gene Symbol: ACTR10;
  Gene Name: actin-related prt 10 homolog (S. cerevisiae);
  ENSP ID: ENSP00000452586
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVNPSSKLLGSTTPRRKSSSQRVGNSTIGTMYC

SEQ ID NO: 1572 - protein, 302 aa, Homo sapiens
  Payload ID: 451;
  Gene Symbol: ACTR10;
  Gene Name: actin-related prt 10 homolog (S. cerevisiae);
  ENSP ID: ENSP00000477173
  MOD_RES (1)..(1): Any amino acid
XPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPPNVDYPLDGEKILHILGSIRDSVVEILFEQDNEEQSVATLILDSLIQCCSCCPGWSAMA

SEQ ID NO: 1573 - protein, 226 aa, Homo sapiens
  Payload ID: 452;
  Gene Symbol: ARPIN;
  Gene Name: actin-related prt 2/3 complex inhibitor;
  Uniprot ID:  Q7Z6K5;
  ENSP ID: ENSP00000350075
MSRIYHDGALRNKAVQSVRLPGAWDPAAHQGGNGVLLEGELIDVSRHSILDTHGRKERYYVLYIRPSHIHRRKFDAKGNEIEPNFSATRKVNTGFLMSSYKVEAKGDTDRLTPEALKGLVNKPELLALTESLTPDHTVAFWMPESEMEVMELELGAGVRLKTRGDGPFLDSLAKLEAGTVTKCNFTGDGKTGASWTDNIMAQKCSKGAAAEIREQGDGAEDEEWDD

SEQ ID NO: 1574 - protein, 136 aa, Homo sapiens
  Payload ID: 452;
  Gene Symbol: ARPIN;
  Gene Name: actin-related prt 2/3 complex inhibitor;
  ENSP ID: ENSP00000453006
  MOD_RES (1)..(1): Any amino acid
XALKGLVNKPELLALTESLTPDHTVAFWMPESEMEVMELELGAGVRLKTRGDGPFLDSLAKLEAGTVTKCNFTGDGKTGASWTDNIMAQKCSKGAAAEIREQGDGAEDEEWVGTWCWCSCISWQEHGTYWLRLWVG

SEQ ID NO: 1575 - protein, 130 aa, Homo sapiens
  Payload ID: 452;
  Gene Symbol: ARPIN;
  Gene Name: actin-related prt 2/3 complex inhibitor;
  ENSP ID: ENSP00000453687
MSSYKVEAKGDTDRLTPEALKGLVNKPELLALTESLTPDHTVAFWMPESEMEVMELELGAGVRLKTRGDGPFLDSLAKLEAGTVTKCNFTGDGKTGASWTDNIMAQKCSKGAAAEIREQGDGAEDEEWDD

SEQ ID NO: 1576 - protein, 376 aa, Homo sapiens
  Payload ID: 453;
  Gene Symbol: ACTRT1;
  Gene Name: actin-related prt T1;
  Uniprot ID:  Q8TDG2;
  ENSP ID: ENSP00000360165
MFNPHALDVPAVIFDNGSGLCKAGLSGEIGPRHVISSVLGHCKFNVPLARLNQKYFVGQEALYKYEALHLHYPIERGLVTGWDDMEKLWKHLFERELGVKPSQQPVLMTEPSLNPREIREKLAEMMFETFSVPGFYLSNHAVAALYASACVTGLVVDSGDGVTCTVPIFEGYSLPHAVTKLCMAGRDITEHLTRLLFASGFNFPCILNKAVVNNIKEKLCYIALEPEKELRKSRGEVLGAYRLPDGHVIHFGDELYQVPEVLFAPDQLGIHSPGLSKMVSSSIMKCDTDIQNKLYADIVLSGGTTLLPGLEERLMKEVEQLASKGTPIKITASPDRCFSAWIGASIMTSMSSFKQMWVTSADFKEYGTSVVQRRCF

SEQ ID NO: 1577 - protein, 377 aa, Homo sapiens
  Payload ID: 454;
  Gene Symbol: ACTRT2;
  Gene Name: actin-related prt T2;
  Uniprot ID:  Q8TDY3;
  ENSP ID: ENSP00000367658
MFNPHALDSPAVIFDNGSGFCKAGLSGEFGPRHMVSSIVGHLKFQAPSAEANQKKYFVGEEALYKQEALQLHSPFERGLITGWDDVERLWKHLFEWELGVKPSDQPLLATEPSLNPRENREKMAEVMFENFGVPAFYLSDQAVLALYASACVTGLVVDSGDAVTCTVPIFEGYSLPHAVTKLHVAGRDITELLMQLLLASGHTFPCQLDKGLVDDIKKKLCYVALEPEKELSRRPEEVLREYKLPDGNIISLGDPLHQAPEALFVPQQLGSQSPGLSNMVSSSITKCDTDIQKILFGEIVLSGGTTLFHGLDDRLLKELEQLASKDTPIKITAPPDRWFSTWIGASIVTSLSSFKQMWVTAADFKEFGTSVVQRRCF

SEQ ID NO: 1578 - protein, 372 aa, Homo sapiens
  Payload ID: 455;
  Gene Symbol: ACTRT3;
  Gene Name: actin-related prt T3;
  Uniprot ID:  Q9BYD9;
  ENSP ID: ENSP00000333037
MNHCQLPVVIDNGSGMIKAGVAGCREPQFIYPNIIGRAKGQSRAAQGGLELCVGDQAQDWRSSLFISYPVERGLITSWEDMEIMWKHIYDYNLKLKPCDGPVLITEPALNPLANRQQITEMFFEHLGVPAFYMSIQAVLALFAAGFTTGLVLNSGAGVTQSVPIFEGYCLPHGVQQLDLAGLDLTNYLMVLMKNHGIMLLSASDRKIVEDIKESFCYVAMNYEEEMAKKPDCLEKVYQLPDGKVIQLHDQLFSCPEALFSPCHMNLEAPGIDKICFSSIMKCDTGLRNSFFSNIILAGGSTSFPGLDKRLVKDIAKVAPANTAVQVIAPPERKISVWMGGSILASLSAFQDMWITAAEFKEVGPNIVHQRCF

SEQ ID NO: 1579 - protein, 583 aa, Homo sapiens
  Payload ID: 456;
  Gene Symbol: ALCAM;
  Gene Name: activated leukocyte cell adhesion molecule;
  Uniprot ID:  Q13740;
  ENSP ID: ENSP00000305988
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 1580 - protein, 532 aa, Homo sapiens
  Payload ID: 456;
  Gene Symbol: ALCAM;
  Gene Name: activated leukocyte cell adhesion molecule;
  ENSP ID: ENSP00000418213
MFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 1581 - protein, 344 aa, Homo sapiens
  Payload ID: 456;
  Gene Symbol: ALCAM;
  Gene Name: activated leukocyte cell adhesion molecule;
  ENSP ID: ENSP00000418937
  MOD_RES (1)..(1): Any amino acid
XLGDCISEDSYPDGNITWYRNGKVLHPLEGAVVIIFKKEMDPVTQLYTMTSTLEYKTTKADIQMPFTCSVTYYGPSGQKTIHSEQAVFDIYYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 1582 - protein, 570 aa, Homo sapiens
  Payload ID: 456;
  Gene Symbol: ALCAM;
  Gene Name: activated leukocyte cell adhesion molecule;
  Uniprot ID:  Q13740;
  ENSP ID: ENSP00000419236
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSANENREKVNDQAKLIVGIVVGLLLAALVAGVVYWLYMKKSKTASKHVNKDLGNMEENKKLEENNHKTEA

SEQ ID NO: 1583 - protein, 357 aa, Homo sapiens
  Payload ID: 457;
  Gene Symbol: ASCC1;
  Gene Name: activating signal cointegrator 1 complex subunit 1;
  Uniprot ID:  Q8N9N2;
  ENSP ID: ENSP00000320461
MEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEIVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFINDISGGKPLEVEMAGIEYMNDDPGMVDVLYAKVHMKDGSNRLQELVDRVLERFQASGLIVKEWNSVKLHATVMNTLFRKDPNAEGRYNLYTAEGKYIFKERESFDGRNILKLFENFYFGSLKLNSIHISQRFTVDSFGNYASCGQIDFS

SEQ ID NO: 1584 - protein, 357 aa, Homo sapiens; identical to SEQ ID NO: 1583
  Payload ID: 457;
  Gene Symbol: ASCC1;
  Gene Name: activating signal cointegrator 1 complex subunit 1;
  Uniprot ID:  Q8N9N2;
  ENSP ID: ENSP00000320810

SEQ ID NO: 1585 - protein, 400 aa, Homo sapiens
  Payload ID: 457;
  Gene Symbol: ASCC1;
  Gene Name: activating signal cointegrator 1 complex subunit 1;
  Uniprot ID:  Q8N9N2;
  ENSP ID: ENSP00000339404
MEVLRPQLIRIDGRNYRKNPVQEQTYQHEEDEEDFYQGSMECADEPCDAYEVEQTPQGFRSTLRAPSLLYNLIHLNTSNDCGFQKITLDCQNIYTWKSRHIVGKRGDTRKKIEMETKTSISIPKPGQDGEIVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFINDISGGKPLEVEMAGIEYMNDDPGMVDVLYAKVHMKDGSNRLQELVDRVLERFQASGLIVKEWNSVKLHATVMNTLFRKDPNAEGRYNLYTAEGKYIFKERESFDGRNILKSFALLPRLEYNDAISAHCNLCLPGSSDSPASASQVAGITGVSDAYSQSLPGKS

SEQ ID NO: 1586 - protein, 400 aa, Homo sapiens; identical to SEQ ID NO: 1585
  Payload ID: 457;
  Gene Symbol: ASCC1;
  Gene Name: activating signal cointegrator 1 complex subunit 1;
  Uniprot ID:  Q8N9N2;
  ENSP ID: ENSP00000378373

SEQ ID NO: 1587 - protein, 357 aa, Homo sapiens; identical to SEQ ID NO: 1583
  Payload ID: 457;
  Gene Symbol: ASCC1;
  Gene Name: activating signal cointegrator 1 complex subunit 1;
  Uniprot ID:  Q8N9N2;
  ENSP ID: ENSP00000378377

SEQ ID NO: 1588 - protein, 124 aa, Homo sapiens
  Payload ID: 457;
  Gene Symbol: ASCC1;
  Gene Name: activating signal cointegrator 1 complex subunit 1;
  ENSP ID: ENSP00000431255
MECADEPCDAYEVEQTPQGFRSTLRAPSLLYKHIVGKRGDTRKKIEMETKTSISIPKPGQDGEIVITGQHRNGVISARTRIDVLLDTFRRKQPFTHFLAFFLNEVEVQEGFLRFQEEVLAKCSM

SEQ ID NO: 1589 - protein, 292 aa, Homo sapiens
  Payload ID: 457;
  Gene Symbol: ASCC1;
  Gene Name: activating signal cointegrator 1 complex subunit 1;
  ENSP ID: ENSP00000431299
  MOD_RES (1)..(1): Any amino acid
XYKHIVGKRGDTRKKIEMETKTSISIPKPGQDGEIVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFINDISGGKPLEVEMAGIEYMNDDPGMVDVLYAKVHMKDGSNRLQELVDRVLERFQASGLIVKEWNSVKLHATVMNTLFRKDPNAEGRYNLYTAEGKYIFKERESFDGRNILKSFALLPRLEYNDAISAHCNLCLPGSSDSPASASQVAGITVV

SEQ ID NO: 1590 - protein, 103 aa, Homo sapiens
  Payload ID: 457;
  Gene Symbol: ASCC1;
  Gene Name: activating signal cointegrator 1 complex subunit 1;
  ENSP ID: ENSP00000431419
MEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEI

SEQ ID NO: 1591 - protein, 123 aa, Homo sapiens
  Payload ID: 457;
  Gene Symbol: ASCC1;
  Gene Name: activating signal cointegrator 1 complex subunit 1;
  ENSP ID: ENSP00000431573
MEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEIVITGQHRNGVISARTRIDVL

SEQ ID NO: 1592 - protein, 56 aa, Homo sapiens
  Payload ID: 457;
  Gene Symbol: ASCC1;
  Gene Name: activating signal cointegrator 1 complex subunit 1;
  ENSP ID: ENSP00000431746
MEVLRPQLIRIDGRNYRKNPVQEQTYQHEEDEEDFYQGSMECADEPCDAYEVEQTP

SEQ ID NO: 1593 - protein, 152 aa, Homo sapiens
  Payload ID: 457;
  Gene Symbol: ASCC1;
  Gene Name: activating signal cointegrator 1 complex subunit 1;
  ENSP ID: ENSP00000432418
MEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEIVITGQHRNGVISARTRIDVLLDTFRRKQPFTHFLAFFLNEVEVQEGFLR

SEQ ID NO: 1594 - protein, 43 aa, Homo sapiens
  Payload ID: 457;
  Gene Symbol: ASCC1;
  Gene Name: activating signal cointegrator 1 complex subunit 1;
  ENSP ID: ENSP00000434468
MEVLRPQLIRIDGRNYRKNPVQEQTYQHEEDEEDFYQGWSAVA

SEQ ID NO: 1595 - protein, 176 aa, Homo sapiens
  Payload ID: 457;
  Gene Symbol: ASCC1;
  Gene Name: activating signal cointegrator 1 complex subunit 1;
  ENSP ID: ENSP00000435147
  MOD_RES (1)..(1): Any amino acid
XITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFIKLQELVDRVLERFQASGLIVKEWNSVKLHATVMNTLFRKDPNAEGRYNLYTAEGKYIFKERESFDGRNILK

SEQ ID NO: 1596 - protein, 70 aa, Homo sapiens
  Payload ID: 457;
  Gene Symbol: ASCC1;
  Gene Name: activating signal cointegrator 1 complex subunit 1;
  ENSP ID: ENSP00000435191
  MOD_RES (1)..(1): Any amino acid
XLIHLNTSNDCGFQKITLDCQNIYTWKSRHIVGKRGDTRKKIEMETKTSISIPKPGQDGEIEKSEKEMIW

SEQ ID NO: 1597 - protein, 139 aa, Homo sapiens
  Payload ID: 457;
  Gene Symbol: ASCC1;
  Gene Name: activating signal cointegrator 1 complex subunit 1;
  ENSP ID: ENSP00000436098
MEVLRPQLIRIDGRNYRKNPVQEQTYQHEEDEEDFYQVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKE

SEQ ID NO: 1598 - protein, 145 aa, Homo sapiens
  Payload ID: 457;
  Gene Symbol: ASCC1;
  Gene Name: activating signal cointegrator 1 complex subunit 1;
  ENSP ID: ENSP00000436409
  MOD_RES (1)..(1): Any amino acid
XKEEFINDISGGKPLEVEMAGIEYMNDDPGMVDVLYAKVHMKDGSNRLQELVDRVLERFQASGLIVKEWNSVKLHATVMNTLFRKDPNAEGRYNLYTAEGKYIFKERESFDGRNILKVSLMHILRAYQENPRIEKGLGHRELVVV

SEQ ID NO: 1599 - protein, 757 aa, Homo sapiens
  Payload ID: 458;
  Gene Symbol: ASCC2;
  Gene Name: activating signal cointegrator 1 complex subunit 2;
  Uniprot ID:  Q9H1I8;
  ENSP ID: ENSP00000305502
MPALPLDQLQITHKDPKTGKLRTSPALHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 1600 - protein, 757 aa, Homo sapiens; identical to SEQ ID NO: 1599
  Payload ID: 458;
  Gene Symbol: ASCC2;
  Gene Name: activating signal cointegrator 1 complex subunit 2;
  Uniprot ID:  Q9H1I8;
  ENSP ID: ENSP00000380877

SEQ ID NO: 1601 - protein, 78 aa, Homo sapiens
  Payload ID: 458;
  Gene Symbol: ASCC2;
  Gene Name: activating signal cointegrator 1 complex subunit 2;
  ENSP ID: ENSP00000397077
MPALPLDQLQITHKDPKTGKLRTSPALETSLHSSQVTTVTWMKPCLPSFRSSAISSSTVVCKGTGPIPHPRSLRRGAD

SEQ ID NO: 1602 - protein, 37 aa, Homo sapiens
  Payload ID: 458;
  Gene Symbol: ASCC2;
  Gene Name: activating signal cointegrator 1 complex subunit 2;
  ENSP ID: ENSP00000403031
MPALPLDQLQITHKDPKTGKLRTSPALICTCNSMIQI

SEQ ID NO: 1603 - protein, 37 aa, Homo sapiens; identical to SEQ ID NO: 1602
  Payload ID: 458;
  Gene Symbol: ASCC2;
  Gene Name: activating signal cointegrator 1 complex subunit 2;
  ENSP ID: ENSP00000408930

SEQ ID NO: 1604 - protein, 54 aa, Homo sapiens
  Payload ID: 458;
  Gene Symbol: ASCC2;
  Gene Name: activating signal cointegrator 1 complex subunit 2;
  ENSP ID: ENSP00000410531
  MOD_RES (1)..(1): Any amino acid
XSAGAQGAVTVVGGGGGGGGTEPVVEPPRPPRVCRDHVCLICWDPRAGTGQVIL

SEQ ID NO: 1605 - protein, 240 aa, Homo sapiens
  Payload ID: 458;
  Gene Symbol: ASCC2;
  Gene Name: activating signal cointegrator 1 complex subunit 2;
  ENSP ID: ENSP00000412382
MPALPLDQLQITHKDPKTGKLRTSPALHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLL

SEQ ID NO: 1606 - protein, 87 aa, Homo sapiens
  Payload ID: 458;
  Gene Symbol: ASCC2;
  Gene Name: activating signal cointegrator 1 complex subunit 2;
  ENSP ID: ENSP00000414545
SWPAWSTTTTTQSREMKPDPTPLLTSRHNVFQNDEFDVFSRDSVDLSRVHKGKSTRKEENTRSLLNDKRAVAAQRQRYEQYSVVVEE

SEQ ID NO: 1607 - protein, 681 aa, Homo sapiens
  Payload ID: 458;
  Gene Symbol: ASCC2;
  Gene Name: activating signal cointegrator 1 complex subunit 2;
  Uniprot ID:  Q9H1I8;
  ENSP ID: ENSP00000437570
MPALPLDQLQITHKDPKTGKLRTSPALVIFDETLQKCLDSYLRYVPRKFDEGVASAPEVVDMQKRLHRSVFLTFLRMSTHKESKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 1608 - protein, 48 aa, Homo sapiens
  Payload ID: 459;
  Gene Symbol: ASCC3;
  Gene Name: activating signal cointegrator 1 complex subunit 3;
  ENSP ID: ENSP00000320252
MALPRLTGALRSFSNVTKQDNYNEEVADLKLELIMGEKQLKVGLHFSS

SEQ ID NO: 1609 - protein, 176 aa, Homo sapiens
  Payload ID: 459;
  Gene Symbol: ASCC3;
  Gene Name: activating signal cointegrator 1 complex subunit 3;
  ENSP ID: ENSP00000320777
MALPRLTGALRSFSNVTKQDNYNEEVADLKIKRSKLHEQVLDLGLTWKKIIKFLNEKLEKSKMQSINEDLKDILHAAKQIVGTDNGREAIESGAAFLFMTFHLKDSVGHKETKAIKQMFGPFPSSSATAACNATNRIISHFSQDDLTALVQMTEKEHGDRVFFGKNLAFSFDMHDL

SEQ ID NO: 1610 - protein, 111 aa, Homo sapiens
  Payload ID: 459;
  Gene Symbol: ASCC3;
  Gene Name: activating signal cointegrator 1 complex subunit 3;
  Uniprot ID:  Q8N3C0;
  ENSP ID: ENSP00000358139
MALPRLTGALRSFSNVTKQDNYNEEVADLKIKRSKLHEQVLDLGLTWKKIIKFLNEKLEKSKMQSINEDLKDILHAAKQIEVNCPFQKRRLDGKEEDEKMSRASDRFRGLR

SEQ ID NO: 1611 - protein, 2202 aa, Homo sapiens
  Payload ID: 459;
  Gene Symbol: ASCC3;
  Gene Name: activating signal cointegrator 1 complex subunit 3;
  Uniprot ID:  Q8N3C0;
  ENSP ID: ENSP00000358159
MALPRLTGALRSFSNVTKQDNYNEEVADLKIKRSKLHEQVLDLGLTWKKIIKFLNEKLEKSKMQSINEDLKDILHAAKQIVGTDNGREAIESGAAFLFMTFHLKDSVGHKETKAIKQMFGPFPSSSATAACNATNRIISHFSQDDLTALVQMTEKEHGDRVFFGKNLAFSFDMHDLDHFDELPINGETQKTISLDYKKFLNEHLQEACTPELKPVEKTNGSFLWCEVEKYLNSTLKEMTEVPRVEDLCCTLYDMLASIKSGDELQDELFELLGPEGLELIEKLLQNRITIVDRFLNSSNDHRFQALQDNCKKILGENAKPNYGCQVTIQSEQEKQLMKQYRREEKRIARREKKAGEDLEVSEGLMCFDPKELRIQREQALLNARSVPILSRQRDADVEKIHYPHVYDSQAEAMKTSAFIAGAKMILPEGIQRENNKLYEEVRIPYSEPMPLSFEEKPVYIQDLDEIGQLAFKGMKRLNRIQSIVFETAYNTNENMLICAPTGAGKTNIAMLTVLHEIRQHFQQGVIKKNEFKIVYVAPMKALAAEMTDYFSRRLEPLGIIVKELTGDMQLSKSEILRTQMLVTTPEKWDVVTRKSVGDVALSQIVRLLILDEVHLLHEDRGPVLESIVARTLRQVESTQSMIRILGLSATLPNYLDVATFLHVNPYIGLFFFDGRFRPVPLGQTFLGIKCANKMQQLNNMDEVCYENVLKQVKAGHQVMVFVHARNATVRTAMSLIERAKNCGHIPFFFPTQGHDYVLAEKQVQRSRNKQVRELFPDGFSIHHAGMLRQDRNLVENLFSNGHIKVLVCTATLAWGVNLPAHAVIIKGTQIYAAKRGSFVDLGILDVMQIFGRAGRPQFDKFGEGIIITTHDKLSHYLTLLTQRNPIESQFLESLADNLNAEIALGTVTNVEEAVKWISYTYLYVRMRANPLAYGISHKAYQIDPTLRKHREQLVIEVGRKLDKAQMIRFEERTGYFSSTDLGRTASHYYIKYNTIETFNELFDAHKTEGDIFAIVSKAEEFDQIKVREEEIEELDTLLSNFCELSTPGGVENSYGKINILLQTYISRGEMDSFSLISDSAYVAQNAARIVRALFEIALRKRWPTMTYRLLNLSKVIDKRLWGWASPLRQFSILPPHILTRLEEKKLTVDKLKDMRKDEIGHILHHVNIGLKVKQCVHQIPSVMMEASIQPITRTVLRVTLSIYADFTWNDQVHGTVGEPWWIWVEDPTNDHIYHSEYFLALKKQVISKEAQLLVFTIPIFEPLPSQYYIRAVSDRWLGAEAVCIINFQHLILPERHPPHTELLDLQPLPITALGCKAYEALYNFSHFNPVQTQIFHTLYHTDCNVLLGAPTGSGKTVAAELAIFRVFNKYPTSKAVYIAPLKALVRERMDDWKVRIEEKLGKKVIELTGDVTPDMKSIAKADLIVTTPEKWDGVSRSWQNRNYVQQVTILIIDEIHLLGEERGPVLEVIVSRTNFISSHTEKPVRIVGLSTALANARDLADWLNIKQMGLFNFRPSVRPVPLEVHIQGFPGQHYCPRMASMNKPAFQAIRSHSPAKPVLIFVSSRRQTRLTALELIAFLATEEDPKQWLNMDEREMENIIATVRDSNLKLTLAFGIGMHHAGLHERDRKTVEELFVNCKVQVLIATSTLAWGVNFPAHLVIIKGTEYYDGKTRRYVDFPITDVLQMMGRAGRPQFDDQGKAVILVHDIKKDFYKKFLYEPFPVESSLLGVLSDHLNAEIAGGTITSKQDALDYITWTYFFRRLIMNPSYYNLGDVSHDSVNKFLSHLIEKSLIELELSYCIEIGEDNRSIEPLTYGRIASYYYLKHQTVKMFKDRLKPECSTEELLSILSDAEEYTDLPVRHNEDHMNSELAKCLPIESNPHSFDSPHTKAHLLLQAHLSRAMLPCPDYDTDTKTVLDQALRVCQAMLDVAANQGWLVTVLNITNLIQMVIQGRWLKDSSLLTLPNIENHHLHLFKKWKPIMKGPHARGRTSIESLPELIHACGGKDHVFSSMVESELHAAKTKQAWNFLSHLPVINVGISVKGSWDDLVEGHNELSVSTLTADKRDDNKWIKLHADQEYVLQVSLQRVHFGFHKGKPESCAVTPRFPKSKDEGWFLILGEVDKRELIALKRVGYIRNHHVASLSFYTPEIPGRYIYTLYFMSDCYLGLDQQYDIYLNVTQASLSAQVNTKVSDSLTDLALK

SEQ ID NO: 1612 - protein, 731 aa, Homo sapiens
  Payload ID: 459;
  Gene Symbol: ASCC3;
  Gene Name: activating signal cointegrator 1 complex subunit 3;
  Uniprot ID:  Q8N3C0;
  ENSP ID: ENSP00000430769
MALPRLTGALRSFSNVTKQDNYNEEVADLKIKRSKLHEQVLDLGLTWKKIIKFLNEKLEKSKMQSINEDLKDILHAAKQIVGTDNGREAIESGAAFLFMTFHLKDSVGHKETKAIKQMFGPFPSSSATAACNATNRIISHFSQDDLTALVQMTEKEHGDRVFFGKNLAFSFDMHDLDHFDELPINGETQKTISLDYKKFLNEHLQEACTPELKPVEKTNGSFLWCEVEKYLNSTLKEMTEVPRVEDLCCTLYDMLASIKSGDELQDELFELLGPEGLELIEKLLQNRITIVDRFLNSSNDHRFQALQDNCKKILGENAKPNYGCQVTIQSEQEKQLMKQYRREEKRIARREKKAGEDLEVSEGLMCFDPKELRIQREQALLNARSVPILSRQRDADVEKIHYPHVYDSQAEAMKTSAFIAGAKMILPEGIQRENNKLYEEVRIPYSEPMPLSFEEKPVYIQDLDEIGQLAFKGMKRLNRIQSIVFETAYNTNENMLICAPTGAGKTNIAMLTVLHEIRQHFQQGVIKKNEFKIVYVAPMKALAAEMTDYFSRRLEPLGIIVKELTGDMQLSKSEILRTQMLVTTPEKWDVVTRKSVGDVALSQIVRLLILDEVHLLHEDRGPVLESIVARTLRQVESTQSMIRILGLSATLPNYLDVATFLHVNPYIGLFFFDGRFRPVPLGQTFLGIKCANKMQQLNNMDEVCYENVLKQVKAGHQVHLFYLLLHLFICF

SEQ ID NO: 1613 - protein, 271 aa, Homo sapiens
  Payload ID: 460;
  Gene Symbol: ATF1;
  Gene Name: activating transcription factor 1;
  Uniprot ID:  P18846;
  ENSP ID: ENSP00000262053
MEDSHKSTTSETAPQPGSAVQGAHISHIAQQVSSLSESEESQDSSDSIGSSQKAHGILARRPSYRKILKDLSSEDTRGRKGDGENSGVSAAVTSMSVPTPIYQTSSGQYIAIAPNGALQLASPGTDGVQGLQTLTMTNSGSTQQGTTILQYAQTSDGQQILVPSNQVVVQTASGDMQTYQIRTTPSATSLPQTVVMTSPVTLTSQTTKTDDPQLKREIRLMKNREAARECRRKKKEYVKCLENRVAVLENQNKTLIEELKTLKDLYSNKSV

SEQ ID NO: 1614 - protein, 77 aa, Homo sapiens
  Payload ID: 460;
  Gene Symbol: ATF1;
  Gene Name: activating transcription factor 1;
  ENSP ID: ENSP00000448421
MEDSHKSTTSETAPQPGSAVQGAHISHIAQQGLTLSPRLVCSSVNIAHCSLDLLCSSNPPASAPQVAGTTGIIFIRK

SEQ ID NO: 1615 - protein, 170 aa, Homo sapiens
  Payload ID: 460;
  Gene Symbol: ATF1;
  Gene Name: activating transcription factor 1;
  ENSP ID: ENSP00000448592
MEDSHKSTTSETAPQPGSAVQGAHISHIAQQVSSLSESEESQDSSDSIGSSQKAHGILARRPSYRKILKDLSSEDTRGRKGDGENSGVSAAVTSMSVPTPIYQTSSGQYIAIAPNGALQLASPGTDGVQGLQTLTMTNSGSTQQGTTILQYAQTSDGQQILVPSNQVVVQ

SEQ ID NO: 1616 - protein, 200 aa, Homo sapiens
  Payload ID: 460;
  Gene Symbol: ATF1;
  Gene Name: activating transcription factor 1;
  ENSP ID: ENSP00000448921
MEDSHKSTTSETAPQPGSAVQGAHISHIAQQVSSLSESEESQDSSDSIGSSQKAHGILARRPSYRKILKDLSSEDTRGRKGDGENSGVSAAVTSMSVPTPIYQTSSGQYIAIAPNGALQLASPGTDGVQGLQTLTMTNSGSTQQGTTILQYAQTSDGQQILVPSNQVVVQTASGDMQTYQIRTTPSATSLPQTVVMTSPV

SEQ ID NO: 1617 - protein, 55 aa, Homo sapiens
  Payload ID: 460;
  Gene Symbol: ATF1;
  Gene Name: activating transcription factor 1;
  ENSP ID: ENSP00000448987
MEDSHKSTTSETAPQPGSAVQGAHISHIAQQLPLPQMEPYSWQVQAQMEYRDFRH

SEQ ID NO: 1618 - protein, 505 aa, Homo sapiens
  Payload ID: 461;
  Gene Symbol: ATF2;
  Gene Name: activating transcription factor 2;
  Uniprot ID:  P15336;
  ENSP ID: ENSP00000264110
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 1619 - protein, 447 aa, Homo sapiens
  Payload ID: 461;
  Gene Symbol: ATF2;
  Gene Name: activating transcription factor 2;
  Uniprot ID:  P15336;
  ENSP ID: ENSP00000340576
MYCAWMWPDQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 1620 - protein, 505 aa, Homo sapiens; identical to SEQ ID NO: 1618
  Payload ID: 461;
  Gene Symbol: ATF2;
  Gene Name: activating transcription factor 2;
  Uniprot ID:  P15336;
  ENSP ID: ENSP00000376327

SEQ ID NO: 1621 - protein, 144 aa, Homo sapiens
  Payload ID: 461;
  Gene Symbol: ATF2;
  Gene Name: activating transcription factor 2;
  Uniprot ID:  P15336;
  ENSP ID: ENSP00000386282
MKFKLHVNSARQYKDLWNMSDDKPFLCTAPGCGQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 1622 - protein, 389 aa, Homo sapiens
  Payload ID: 461;
  Gene Symbol: ATF2;
  Gene Name: activating transcription factor 2;
  ENSP ID: ENSP00000386326
MSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 1623 - protein, 209 aa, Homo sapiens
  Payload ID: 461;
  Gene Symbol: ATF2;
  Gene Name: activating transcription factor 2;
  Uniprot ID:  P15336;
  ENSP ID: ENSP00000386526
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIV

SEQ ID NO: 1624 - protein, 447 aa, Homo sapiens; identical to SEQ ID NO: 1619
  Payload ID: 461;
  Gene Symbol: ATF2;
  Gene Name: activating transcription factor 2;
  Uniprot ID:  P15336;
  ENSP ID: ENSP00000387093

SEQ ID NO: 1625 - protein, 395 aa, Homo sapiens
  Payload ID: 461;
  Gene Symbol: ATF2;
  Gene Name: activating transcription factor 2;
  ENSP ID: ENSP00000389504
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQ

SEQ ID NO: 1626 - protein, 43 aa, Homo sapiens
  Payload ID: 461;
  Gene Symbol: ATF2;
  Gene Name: activating transcription factor 2;
  ENSP ID: ENSP00000402190
MKFKLHVNSARQYKDLWNMSDDKPFLCTAPGCGQIRPQHQQDS

SEQ ID NO: 1627 - protein, 395 aa, Homo sapiens; identical to SEQ ID NO: 1625
  Payload ID: 461;
  Gene Symbol: ATF2;
  Gene Name: activating transcription factor 2;
  ENSP ID: ENSP00000402229

SEQ ID NO: 1628 - protein, 265 aa, Homo sapiens
  Payload ID: 461;
  Gene Symbol: ATF2;
  Gene Name: activating transcription factor 2;
  ENSP ID: ENSP00000406995
  MOD_RES (1)..(1): Any amino acid
XYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASPAHTTPQTQSTSGRRRRAANEDPDEKRRKFLERNRAAASRCRQKRKVWVQSLEKKAEDLSSLNGQLQLLIKMIVQKTFQCRVVHIQKLYSIVRSAHPMESVQPPRQKL

SEQ ID NO: 1629 - protein, 487 aa, Homo sapiens
  Payload ID: 461;
  Gene Symbol: ATF2;
  Gene Name: activating transcription factor 2;
  Uniprot ID:  P15336;
  ENSP ID: ENSP00000407911
MSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 1630 - protein, 43 aa, Homo sapiens; identical to SEQ ID NO: 1626
  Payload ID: 461;
  Gene Symbol: ATF2;
  Gene Name: activating transcription factor 2;
  ENSP ID: ENSP00000410086

SEQ ID NO: 1631 - protein, 237 aa, Homo sapiens
  Payload ID: 461;
  Gene Symbol: ATF2;
  Gene Name: activating transcription factor 2;
  ENSP ID: ENSP00000410224
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVSFDQSPWCLVFQESQVLPLPNQYSQKQK

SEQ ID NO: 1632 - protein, 395 aa, Homo sapiens; identical to SEQ ID NO: 1625
  Payload ID: 461;
  Gene Symbol: ATF2;
  Gene Name: activating transcription factor 2;
  ENSP ID: ENSP00000412293

SEQ ID NO: 1633 - protein, 43 aa, Homo sapiens; identical to SEQ ID NO: 1626
  Payload ID: 461;
  Gene Symbol: ATF2;
  Gene Name: activating transcription factor 2;
  ENSP ID: ENSP00000414171

SEQ ID NO: 1634 - protein, 189 aa, Homo sapiens
  Payload ID: 461;
  Gene Symbol: ATF2;
  Gene Name: activating transcription factor 2;
  ENSP ID: ENSP00000416854
MYCAWMWPDQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVP

SEQ ID NO: 1635 - protein, 329 aa, Homo sapiens [sequence omitted]

SEQ ID NO: 1636 - protein, 106 aa, Homo sapiens
  Payload ID: 462;
  Gene Symbol: ATF3;
  Gene Name: activating transcription factor 3;
  Uniprot ID:  P18847;
  ENSP ID: ENSP00000336908
MMLQHPGQVSASEEELRFAIQNKHLCHRMSSALESVTVSDRPLGVSITKAEVAPEEDERKKRRRERNKIAAAKCRNKKKEKTECLQKLPRPFWVQKTCIWAVDSCK

SEQ ID NO: 1637 - protein, 181 aa, Homo sapiens
  Payload ID: 462;
  Gene Symbol: ATF3;
  Gene Name: activating transcription factor 3;
  Uniprot ID:  P18847;
  ENSP ID: ENSP00000344352
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 1638 - protein, 175 aa, Homo sapiens
  Payload ID: 462;
  Gene Symbol: ATF3;
  Gene Name: activating transcription factor 3;
  ENSP ID: ENSP00000355948
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIK

SEQ ID NO: 1639 - protein, 135 aa, Homo sapiens
  Payload ID: 462;
  Gene Symbol: ATF3;
  Gene Name: activating transcription factor 3;
  Uniprot ID:  P18847;
  ENSP ID: ENSP00000355950
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKLPRPFWVQKTCIWAVDSCK

SEQ ID NO: 1640 - protein, 153 aa, Homo sapiens
  Payload ID: 462;
  Gene Symbol: ATF3;
  Gene Name: activating transcription factor 3;
  ENSP ID: ENSP00000355952
  MOD_RES (1)..(1): Any amino acid
XERSLEQNDASTPRPELRFAIQNKHLCHRMSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 1641 - protein, 181 aa, Homo sapiens; identical to SEQ ID NO: 1637
  Payload ID: 462;
  Gene Symbol: ATF3;
  Gene Name: activating transcription factor 3;
  Uniprot ID:  P18847;
  ENSP ID: ENSP00000355954

SEQ ID NO: 1642 - protein, 135 aa, Homo sapiens; identical to SEQ ID NO: 1639
  Payload ID: 462;
  Gene Symbol: ATF3;
  Gene Name: activating transcription factor 3;
  Uniprot ID:  P18847;
  ENSP ID: ENSP00000432208

SEQ ID NO: 1643 - protein, 124 aa, Homo sapiens
  Payload ID: 462;
  Gene Symbol: ATF3;
  Gene Name: activating transcription factor 3;
  Uniprot ID:  P18847;
  ENSP ID: ENSP00000480606
MSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 1644 - protein, 124 aa, Homo sapiens; identical to SEQ ID NO: 1643
  Payload ID: 462;
  Gene Symbol: ATF3;
  Gene Name: activating transcription factor 3;
  Uniprot ID:  P18847;
  ENSP ID: ENSP00000483576

SEQ ID NO: 1645 - protein, 351 aa, Homo sapiens
  Payload ID: 463;
  Gene Symbol: ATF4;
  Gene Name: activating transcription factor 4;
  Uniprot ID:  P18848;
  ENSP ID: ENSP00000336790
MTEMSFLSSEVLVGDLMSPFDQSGLGAEESLGLLDDYLEVAKHFKPHGFSSDKAKAGSSEWLAVDGLVSPSNNSKEDAFSGTDWMLEKMDLKEFDLDALLGIDDLETMPDDLLTTLDDTCDLFAPLVQETNKQPPQTVNPIGHLPESLTKPDQVAPFTFLQPLPLSPGVLSSTPDHSFSLELGSEVDITEGDRKPDYTAYVAMIPQCIKEEDTPSDNDSGICMSPESYLGSPQHSPSTRGSPNRSLPSPGVLCGSARPKPYDPPGEKMVAAKVKGEKLDKKLKKMEQNKTAATRYRQKKRAEQEALTGECKELEKKNEALKERADSLAKEIQYLKDLIEEVRKARGKKRVP

SEQ ID NO: 1646 - protein, 351 aa, Homo sapiens; identical to SEQ ID NO: 1645
  Payload ID: 463;
  Gene Symbol: ATF4;
  Gene Name: activating transcription factor 4;
  Uniprot ID:  P18848;
  ENSP ID: ENSP00000379912

SEQ ID NO: 1647 - protein, 351 aa, Homo sapiens; identical to SEQ ID NO: 1645
  Payload ID: 463;
  Gene Symbol: ATF4;
  Gene Name: activating transcription factor 4;
  Uniprot ID:  P18848;
  ENSP ID: ENSP00000384587

SEQ ID NO: 1648 - protein, 282 aa, Homo sapiens
  Payload ID: 464;
  Gene Symbol: ATF5;
  Gene Name: activating transcription factor 5;
  Uniprot ID:  Q9Y2D1;
  ENSP ID: ENSP00000396954
MSLLATLGLELDRALLPASGLGWLVDYGKLPPAPAPLAPYEVLGGALEGGLPVGGEPLAGDGFSDWMTERVDFTALLPLEPPLPPGTLPQPSPTPPDLEAMASLLKKELEQMEDFFLDAPPLPPPSPPPLPPPPLPPAPSLPLSLPSFDLPQPPVLDTLDLLAIYCRNEAGQEEVGMPPLPPPQQPPPPSPPQPSRLAPYPHPATTRGDRKQKKRDQNKSAALRYRQRKRAEGEALEGECQGLEARNRELKERAESVEREIQYVKDLLIEVYKARSQRTRSC

SEQ ID NO: 1649 - protein, 129 aa, Homo sapiens
  Payload ID: 464;
  Gene Symbol: ATF5;
  Gene Name: activating transcription factor 5;
  ENSP ID: ENSP00000470464
MSLLATLGLELDRALLPASGLGWLVDYGKLPPAPAPLAPYEVLGGALEGGLPVGGEPLAGDGFSDWMTERVDFTALLPLEPPLPPGTLPQPSPTPPDLEAMASLLKKELEQMEDFFLDAPPLPPPSPPP

SEQ ID NO: 1650 - protein, 282 aa, Homo sapiens; identical to SEQ ID NO: 1648
  Payload ID: 464;
  Gene Symbol: ATF5;
  Gene Name: activating transcription factor 5;
  Uniprot ID:  Q9Y2D1;
  ENSP ID: ENSP00000470633

SEQ ID NO: 1651 - protein, 121 aa, Homo sapiens
  Payload ID: 464;
  Gene Symbol: ATF5;
  Gene Name: activating transcription factor 5;
  ENSP ID: ENSP00000470978
MSLLATLGLELDRALLPASGLGWLVDYGKLPPAPAPLAPYEVLGGALEGGLPVGGEPLAGDGFSDWMTERVDFTALLPLEPPLPPGTLPQPSPTPPDLEAMASLLKKELEQMEDFFLDAPP

SEQ ID NO: 1652 - protein, 88 aa, Homo sapiens
  Payload ID: 464;
  Gene Symbol: ATF5;
  Gene Name: activating transcription factor 5;
  ENSP ID: ENSP00000471162
MSLLATLGLELDRALLPASGLGWLVDYGKLPPAPAPLAPYEVLGGALEGGLPVGGEPLAGKGRWKVELGSGGQGKMGEEELIHVFNKY

SEQ ID NO: 1653 - protein, 670 aa, Homo sapiens
  Payload ID: 465;
  Gene Symbol: ATF6;
  Gene Name: activating transcription factor 6;
  Uniprot ID:  P18850;
  ENSP ID: ENSP00000356919
MGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 1654 - protein, 703 aa, Homo sapiens
  Payload ID: 466;
  Gene Symbol: ATF6B;
  Gene Name: activating transcription factor 6 beta;
  Uniprot ID:  Q99941;
  ENSP ID: ENSP00000293709
MAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 1655 - protein, 700 aa, Homo sapiens
  Payload ID: 466;
  Gene Symbol: ATF6B;
  Gene Name: activating transcription factor 6 beta;
  Uniprot ID:  Q99941;
  ENSP ID: ENSP00000364347
MAELMLLSEIADPTRFFTDNLLSPEDWDSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 1656 - protein, 703 aa, Homo sapiens; identical to SEQ ID NO: 1654
  Payload ID: 466;
  Gene Symbol: ATF6B;
  Gene Name: activating transcription factor 6 beta;
  Uniprot ID:  Q99941;
  ENSP ID: ENSP00000364349

SEQ ID NO: 1657 - protein, 700 aa, Homo sapiens; identical to SEQ ID NO: 1655
  Payload ID: 466;
  Gene Symbol: ATF6B;
  Gene Name: activating transcription factor 6 beta;
  Uniprot ID:  Q99941;
  ENSP ID: ENSP00000372642

SEQ ID NO: 1658 - protein, 142 aa, Homo sapiens
  Payload ID: 466;
  Gene Symbol: ATF6B;
  Gene Name: activating transcription factor 6 beta;
  ENSP ID: ENSP00000389467
  MOD_RES (1)..(1): Any amino acid
XQPSPTDQPSFSNLTAFPGGAKELLLRDLDQLFLSSDCRHFNRTESLRLADELSGWVQRHQRGRRKIPQRAQERQSLDTSPSRSLSHGRSHLQLRQSPSNPLDPQKGILWASCNYIATQTVRSQHSWMQLTDGKTHFMLSLS

SEQ ID NO: 1659 - protein, 700 aa, Homo sapiens; identical to SEQ ID NO: 1655
  Payload ID: 466;
  Gene Symbol: ATF6B;
  Gene Name: activating transcription factor 6 beta;
  Uniprot ID:  Q99941;
  ENSP ID: ENSP00000391131

SEQ ID NO: 1660 - protein, 142 aa, Homo sapiens; identical to SEQ ID NO: 1658
  Payload ID: 466;
  Gene Symbol: ATF6B;
  Gene Name: activating transcription factor 6 beta;
  ENSP ID: ENSP00000393419
  MOD_RES (1)..(1): Any amino acid

SEQ ID NO: 1661 - protein, 700 aa, Homo sapiens; identical to SEQ ID NO: 1655
  Payload ID: 466;
  Gene Symbol: ATF6B;
  Gene Name: activating transcription factor 6 beta;
  Uniprot ID:  Q99941;
  ENSP ID: ENSP00000399764

SEQ ID NO: 1662 - protein, 142 aa, Homo sapiens; identical to SEQ ID NO: 1658
  Payload ID: 466;
  Gene Symbol: ATF6B;
  Gene Name: activating transcription factor 6 beta;
  ENSP ID: ENSP00000399944
  MOD_RES (1)..(1): Any amino acid

SEQ ID NO: 1663 - protein, 703 aa, Homo sapiens; identical to SEQ ID NO: 1654
  Payload ID: 466;
  Gene Symbol: ATF6B;
  Gene Name: activating transcription factor 6 beta;
  Uniprot ID:  Q99941;
  ENSP ID: ENSP00000404725

SEQ ID NO: 1664 - protein, 703 aa, Homo sapiens; identical to SEQ ID NO: 1654
  Payload ID: 466;
  Gene Symbol: ATF6B;
  Gene Name: activating transcription factor 6 beta;
  Uniprot ID:  Q99941;
  ENSP ID: ENSP00000404814

SEQ ID NO: 1665 - protein, 142 aa, Homo sapiens; identical to SEQ ID NO: 1658
  Payload ID: 466;
  Gene Symbol: ATF6B;
  Gene Name: activating transcription factor 6 beta;
  ENSP ID: ENSP00000412066
  MOD_RES (1)..(1): Any amino acid

SEQ ID NO: 1666 - protein, 483 aa, Homo sapiens
  Payload ID: 467;
  Gene Symbol: ATF7;
  Gene Name: activating transcription factor 7;
  Uniprot ID:  P17544;
  ENSP ID: ENSP00000387406
MGDDRPFVCNAPGCGQRFTNEDHLAVHKHKHEMTLKFGPARTDSVIIADQTPTPTRFLKNCEEVGLFNELASSFEHEFKKAADEDEKKAAAGPLDMSLPSTPDIKIKEEEPVEVDSSPPDSPASSPCSPPLKEKEVTPKPVLISTPTPTIVRPGSLPLHLGYDPLHPTLPSPTSVITQAPPSNRQMGSPTGSLPLVMHLANGQTMPVLPGPPVQMPSVISLARPVSMVPNIPGIPGPPVNSSGSISPSGHPIPSEAKMRLKATLTHQVSSINGGCGMVVGTASTMVTARPEQSQILIQHPDAPSPAQPQVSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLESPKESSEPTGSPAPVIQHSSATAPSNGLSVRSAAEAVATSVLTQMASQRTELSMPIQSHVIMTPQSQSAGR

SEQ ID NO: 1667 - protein, 483 aa, Homo sapiens; identical to SEQ ID NO: 1666
  Payload ID: 467;
  Gene Symbol: ATF7;
  Gene Name: activating transcription factor 7;
  Uniprot ID:  P17544;
  ENSP ID: ENSP00000399465

SEQ ID NO: 1668 - protein, 78 aa, Homo sapiens
  Payload ID: 467;
  Gene Symbol: ATF7;
  Gene Name: activating transcription factor 7;
  ENSP ID: ENSP00000449817
MSLPSTPDIKIKEEEPVEVDSSPPDSPASSPCSPPLKEKEVTPKPVLISTPTPTIVRPGSLPLHLGYDPLHPTLPSPT

SEQ ID NO: 1669 - protein, 494 aa, Homo sapiens
  Payload ID: 467;
  Gene Symbol: ATF7;
  Gene Name: activating transcription factor 7;
  Uniprot ID:  P17544;
  ENSP ID: ENSP00000449938
MGDDRPFVCNAPGCGQRFTNEDHLAVHKHKHEMTLKFGPARTDSVIIADQTPTPTRFLKNCEEVGLFNELASSFEHEFKKAADEDEKKARSRTVAKKLVAAAGPLDMSLPSTPDIKIKEEEPVEVDSSPPDSPASSPCSPPLKEKEVTPKPVLISTPTPTIVRPGSLPLHLGYDPLHPTLPSPTSVITQAPPSNRQMGSPTGSLPLVMHLANGQTMPVLPGPPVQMPSVISLARPVSMVPNIPGIPGPPVNSSGSISPSGHPIPSEAKMRLKATLTHQVSSINGGCGMVVGTASTMVTARPEQSQILIQHPDAPSPAQPQVSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLESPKESSEPTGSPAPVIQHSSATAPSNGLSVRSAAEAVATSVLTQMASQRTELSMPIQSHVIMTPQSQSAGR

SEQ ID NO: 1670 - protein, 117 aa, Homo sapiens
  Payload ID: 467;
  Gene Symbol: ATF7;
  Gene Name: activating transcription factor 7;
  Uniprot ID:  P17544;
  ENSP ID: ENSP00000456858
MGDDRPFVCNAPGCGQRFTNEDHLAVHKHKHEMTLKFGPARTDSVIIADQTPTPTRFLKNCEEVGLFNELASSFEHEFKKAADEDEKKARSRTVAKKLVVFRPRLFLLCFGIIFLIG

SEQ ID NO: 1671 - protein, 117 aa, Homo sapiens; identical to SEQ ID NO: 1670
  Payload ID: 467;
  Gene Symbol: ATF7;
  Gene Name: activating transcription factor 7;
  Uniprot ID:  P17544;
  ENSP ID: ENSP00000465192

SEQ ID NO: 1672 - protein, 79 aa, Homo sapiens
  Payload ID: 467;
  Gene Symbol: ATF7;
  Gene Name: activating transcription factor 7;
  ENSP ID: ENSP00000465850
MSLPSTPDIKIKEEEPVEVDSSPPDSPASSPCSPPLKEKEVTPKPVLISTPTPTIVRPGSLPLHLGYDPLHPTLPSPTS

SEQ ID NO: 1673 - protein, 163 aa, Homo sapiens
  Payload ID: 467;
  Gene Symbol: ATF7;
  Gene Name: activating transcription factor 7;
  ENSP ID: ENSP00000468623
MGDDRPFVCNAPGCGQRFTNEDHLAVHKHKHEMTLKFGPARTDSVIIADQTPTPTRFLKNCEEVGLFNELASSFEHEFKKAADEDEKKARSRTVAKKLVAAAGPLDMSLPSTPDIKIKEEEPVEVDSSPPDSPASSPCSPPLKEKEVTPKPVLISTPTPTIVR

SEQ ID NO: 1674 - protein, 1270 aa, Homo sapiens
  Payload ID: 468;
  Gene Symbol: ATF7IP;
  Gene Name: activating transcription factor 7 interacting prt;
  Uniprot ID:  Q6VMQ6;
  ENSP ID: ENSP00000261168
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPAEVESNEKDNKPEEEEQVIHEDDERPSEKNEFSRRKRSKSEDMDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSVTVRVPQTTTYVVNNGLTLGSTGPQLTVHHRPPQVHTEPPRPVHPAPLPEAPQPQRLPPEAASTSLPQKPHLKLARVQSQNGIVLSWSVLEVDRSCATVDSYHLYAYHEEPSATVPSQWKKIGEVKALPLPMACTLTQFVSGSKYYFAVRAKDIYGRFGPFCDPQSTDVISSTQSS

SEQ ID NO: 1675 - protein, 515 aa, Homo sapiens
  Payload ID: 468;
  Gene Symbol: ATF7IP;
  Gene Name: activating transcription factor 7 interacting prt;
  ENSP ID: ENSP00000379575
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNE

SEQ ID NO: 1676 - protein, 125 aa, Homo sapiens
  Payload ID: 468;
  Gene Symbol: ATF7IP;
  Gene Name: activating transcription factor 7 interacting prt;
  ENSP ID: ENSP00000414158
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKL

SEQ ID NO: 1677 - protein, 115 aa, Homo sapiens
  Payload ID: 468;
  Gene Symbol: ATF7IP;
  Gene Name: activating transcription factor 7 interacting prt;
  ENSP ID: ENSP00000437711
  MOD_RES (1)..(1): Any amino acid
XTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNRELNRENC

SEQ ID NO: 1678 - protein, 32 aa, Homo sapiens
  Payload ID: 468;
  Gene Symbol: ATF7IP;
  Gene Name: activating transcription factor 7 interacting prt;
  ENSP ID: ENSP00000439192
MDSLEEPQKKVFKARKTMRVSDRQQLEAVYKV

SEQ ID NO: 1679 - protein, 152 aa, Homo sapiens
  Payload ID: 468;
  Gene Symbol: ATF7IP;
  Gene Name: activating transcription factor 7 interacting prt;
  ENSP ID: ENSP00000439279
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASG

SEQ ID NO: 1680 - protein, 176 aa, Homo sapiens
  Payload ID: 468;
  Gene Symbol: ATF7IP;
  Gene Name: activating transcription factor 7 interacting prt;
  ENSP ID: ENSP00000439578
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATS

SEQ ID NO: 1681 - protein, 1278 aa, Homo sapiens
  Payload ID: 468;
  Gene Symbol: ATF7IP;
  Gene Name: activating transcription factor 7 interacting prt;
  Uniprot ID:  Q6VMQ6;
  ENSP ID: ENSP00000440440
MHQDQRFRMDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPAEVESNEKDNKPEEEEQVIHEDDERPSEKNEFSRRKRSKSEDMDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSVTVRVPQTTTYVVNNGLTLGSTGPQLTVHHRPPQVHTEPPRPVHPAPLPEAPQPQRLPPEAASTSLPQKPHLKLARVQSQNGIVLSWSVLEVDRSCATVDSYHLYAYHEEPSATVPSQWKKIGEVKALPLPMACTLTQFVSGSKYYFAVRAKDIYGRFGPFCDPQSTDVISSTQSS

SEQ ID NO: 1682 - protein, 96 aa, Homo sapiens
  Payload ID: 468;
  Gene Symbol: ATF7IP;
  Gene Name: activating transcription factor 7 interacting prt;
  ENSP ID: ENSP00000440587
MDNVQSKRRRYMEEEYEAEFQVKITAKGDINQKLQKVIQWLLEEKLCALQCAVFDKTLAELKTRVEKIECNKRHKTVLTELQAKIARLTKRFEAAK

SEQ ID NO: 1683 - protein, 169 aa, Homo sapiens
  Payload ID: 468;
  Gene Symbol: ATF7IP;
  Gene Name: activating transcription factor 7 interacting prt;
  ENSP ID: ENSP00000441483
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDA

SEQ ID NO: 1684 - protein, 89 aa, Homo sapiens
  Payload ID: 468;
  Gene Symbol: ATF7IP;
  Gene Name: activating transcription factor 7 interacting prt;
  ENSP ID: ENSP00000442958
MDSLEEPQKKVFKARKTMRVSDRQQLEAVYKVKEELLKTDVKLLNGNHENGDLDPTSPLENMDYIKDKEEVNGIEEICFDPEGSKAEWK

SEQ ID NO: 1685 - protein, 1105 aa, Homo sapiens
  Payload ID: 468;
  Gene Symbol: ATF7IP;
  Gene Name: activating transcription factor 7 interacting prt;
  Uniprot ID:  Q6VMQ6;
  ENSP ID: ENSP00000443179
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPEVESNEKDNKPEEEEQVIHEDDERPSEKNEFSRRKRSKSEDMDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSKRFFLYMAPRYM

SEQ ID NO: 1686 - protein, 132 aa, Homo sapiens
  Payload ID: 468;
  Gene Symbol: ATF7IP;
  Gene Name: activating transcription factor 7 interacting prt;
  ENSP ID: ENSP00000443540
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSG

SEQ ID NO: 1687 - protein, 59 aa, Homo sapiens
  Payload ID: 468;
  Gene Symbol: ATF7IP;
  Gene Name: activating transcription factor 7 interacting prt;
  ENSP ID: ENSP00000443855
MDSLEEPQKKVFKARKTMRVSDRQQLEAVYKVKEELLKTDVKLLNGNHENGDLDPTSPL

SEQ ID NO: 1688 - protein, 1270 aa, Homo sapiens; identical to SEQ ID NO: 1674
  Payload ID: 468;
  Gene Symbol: ATF7IP;
  Gene Name: activating transcription factor 7 interacting prt;
  Uniprot ID:  Q6VMQ6;
  ENSP ID: ENSP00000444589

SEQ ID NO: 1689 - protein, 143 aa, Homo sapiens
  Payload ID: 468;
  Gene Symbol: ATF7IP;
  Gene Name: activating transcription factor 7 interacting prt;
  ENSP ID: ENSP00000444620
MDSLEEPQKKVFKARKTMRVSDRQQLEAVYKVKEELLKTDVKLLNGNHENGDLDPTSPLENMDYIKDKEEVNGIEEICFDPEGSKAEFQVKITAKGDINQKLQKVIQWLLEEKLCALQCAVFDKTLAELKTRVEKIECNKRHK

SEQ ID NO: 1690 - protein, 176 aa, Homo sapiens; identical to SEQ ID NO: 1680
  Payload ID: 468;
  Gene Symbol: ATF7IP;
  Gene Name: activating transcription factor 7 interacting prt;
  ENSP ID: ENSP00000444784

SEQ ID NO: 1691 - protein, 103 aa, Homo sapiens
  Payload ID: 468;
  Gene Symbol: ATF7IP;
  Gene Name: activating transcription factor 7 interacting prt;
  ENSP ID: ENSP00000445604
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQ

SEQ ID NO: 1692 - protein, 1269 aa, Homo sapiens
  Payload ID: 468;
  Gene Symbol: ATF7IP;
  Gene Name: activating transcription factor 7 interacting prt;
  Uniprot ID:  Q6VMQ6;
  ENSP ID: ENSP00000445955
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPEVESNEKDNKPEEEEQVIHEDDERPSEKNEFSRRKRSKSEDMDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSVTVRVPQTTTYVVNNGLTLGSTGPQLTVHHRPPQVHTEPPRPVHPAPLPEAPQPQRLPPEAASTSLPQKPHLKLARVQSQNGIVLSWSVLEVDRSCATVDSYHLYAYHEEPSATVPSQWKKIGEVKALPLPMACTLTQFVSGSKYYFAVRAKDIYGRFGPFCDPQSTDVISSTQSS

SEQ ID NO: 1693 - protein, 168 aa, Homo sapiens
  Payload ID: 468;
  Gene Symbol: ATF7IP;
  Gene Name: activating transcription factor 7 interacting prt;
  ENSP ID: ENSP00000446260
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSD

SEQ ID NO: 1694 - protein, 543 aa, Homo sapiens
  Payload ID: 469;
  Gene Symbol: ATF7IP2;
  Gene Name: activating transcription factor 7 interacting prt 2;
  Uniprot ID:  Q5U623;
  ENSP ID: ENSP00000322811
MASPDRSKRKILKAKKTMPLSCRKQVEMLNKSRNVEALKTAIGSNVPSGNQSFSPSVITRTTEITKCSPSENGASSLDSNKNSISEKSKVFSQNCIKPVEEIVHSETKLEQVVCSYQKPSRTTESPSRVFTEEAKDSLNTSENDSEHQTNVTRSLFEHEGACSLKSSCCPPSVLSGVVQMPESTVTSTVGDKKTDQMVFHLETNSNSESHDKRQSDNILCSEDSGFVPVEKTPNLVNSVTSNNCADDILKTDECSRTSISNCESADSTWQSSLDTNNNSHYQKKRMFSENEENVKRMKTSEQINENICVSLERQTAFLEQVRHLIQQEIYSINYELFDKKLKELNQRIGKTECRNKHEGIADKLLAKIAKLQRRIKTVLLFQRNCLKPNMLSSNGASKVANSEAMILDKNLESVNSPIEKSSVNYEPSNPSEKGSKKINLSSDQNKSVSESNNDDVMLISVESPNLTTPITSNPTDTRKITSGNSSNSPNAEVMKVQYPPWSHIRKLLQTQRKQPHWHKMQSRFLSPLSTCHLSQNHQHHYLN

SEQ ID NO: 1695 - protein, 682 aa, Homo sapiens
  Payload ID: 469;
  Gene Symbol: ATF7IP2;
  Gene Name: activating transcription factor 7 interacting prt 2;
  Uniprot ID:  Q5U623;
  ENSP ID: ENSP00000348799
MASPDRSKRKILKAKKTMPLSCRKQVEMLNKSRNVEALKTAIGSNVPSGNQSFSPSVITRTTEITKCSPSENGASSLDSNKNSISEKSKVFSQNCIKPVEEIVHSETKLEQVVCSYQKPSRTTESPSRVFTEEAKDSLNTSENDSEHQTNVTRSLFEHEGACSLKSSCCPPSVLSGVVQMPESTVTSTVGDKKTDQMVFHLETNSNSESHDKRQSDNILCSEDSGFVPVEKTPNLVNSVTSNNCADDILKTDECSRTSISNCESADSTWQSSLDTNNNSHYQKKRMFSENEENVKRMKTSEQINENICVSLERQTAFLEQVRHLIQQEIYSINYELFDKKLKELNQRIGKTECRNKHEGIADKLLAKIAKLQRRIKTVLLFQRNCLKPNMLSSNGASKVANSEAMILDKNLESVNSPIEKSSVNYEPSNPSEKGSKKINLSSDQNKSVSESNNDDVMLISVESPNLTTPITSNPTDTRKITSGNSSNSPNAEVMAVQKKLDSIIDLTKEGLSNCNTESPVSPLESHSKAASNSKETTPLAQNAVQVPESFEHLPPLPEPPAPLPELVDKTRDTLPPQKPELKVKRVFRPNGIALTWNITKINPKCAPVESYHLFLCHENSNNKLIWKKIGEIKALPLPMACTLSQFLASNRYYFTVQSKDIFGRYGPFCDIKSIPGFSENLT

SEQ ID NO: 1696 - protein, 543 aa, Homo sapiens; identical to SEQ ID NO: 1694
  Payload ID: 469;
  Gene Symbol: ATF7IP2;
  Gene Name: activating transcription factor 7 interacting prt 2;
  Uniprot ID:  Q5U623;
  ENSP ID: ENSP00000379807

SEQ ID NO: 1697 - protein, 682 aa, Homo sapiens; identical to SEQ ID NO: 1695
  Payload ID: 469;
  Gene Symbol: ATF7IP2;
  Gene Name: activating transcription factor 7 interacting prt 2;
  Uniprot ID:  Q5U623;
  ENSP ID: ENSP00000379808

SEQ ID NO: 1698 - protein, 425 aa, Homo sapiens
  Payload ID: 469;
  Gene Symbol: ATF7IP2;
  Gene Name: activating transcription factor 7 interacting prt 2;
  ENSP ID: ENSP00000440791
MASPDRSKRKILKAKKTMPLSCRKQVEMLNKSRNVEALKTAIGSNVPSGNQSFSPSVITRTTEITKCSPSENGASSLDSNKNSISEKSKVFSQNCIKPVEEIVHSETKLEQVVCSYQKPSRTTESPSRVFTEEAKDSLNTSENDSEHQTNVTRSLFEHEGACSLKSSCCPPSVLSGVVQMPESTVTSTVGDKKTDQMVFHLETNSNSESHDKRQSDNILCSEDSGFVPVEKTPNLVNSVTSNNCADDILKTDECSRTSISNCESADSTWQSSLDTNNNSHYQKKRMFSENEENVKRMKTSEQINENICVSLERQTAFLEQVRHLIQQEIYSINYELFDKKLKELNQRIGKTECRNKHEGIADKLLAKIAKLQRRIKTVLLFQRNCLKPNMLSSNGASKIPEKLHQEILAILPMLKLWLYRRNLIL

SEQ ID NO: 1699 - protein, 226 aa, Homo sapiens
  Payload ID: 469;
  Gene Symbol: ATF7IP2;
  Gene Name: activating transcription factor 7 interacting prt 2;
  ENSP ID: ENSP00000446119
MLISVESPNLTTPITSNPTDTRKITSGNSSNSPNAEVMAVQKKLDSIIDLTKEGLSNCNTESPVSPLESHSKAASNSKETTPLAQNAVQVPESFEHLPPLPEPPAPLPELVDKTRDTLPPQKPELKVKRVFRPNGIALTWNITKINPKCAPVESYHLFLCHENSNNKLIWKKIGEIKALPLPMACTLSQFLASNRYYFTVQSKDIFGRYGPFCDIKSIPGFSENLT

SEQ ID NO: 1700 - protein, 26 aa, Homo sapiens
  Payload ID: 469;
  Gene Symbol: ATF7IP2;
  Gene Name: activating transcription factor 7 interacting prt 2;
  ENSP ID: ENSP00000454809
MASPDRSKRKILKAKKTMPLSCRKQV

SEQ ID NO: 1701 - protein, 398 aa, Homo sapiens
  Payload ID: 469;
  Gene Symbol: ATF7IP2;
  Gene Name: activating transcription factor 7 interacting prt 2;
  ENSP ID: ENSP00000455259
MASPDRSKRKILKAKKTMPLSCRKQVEMLNKSRNVEALKTAIGSNVPSGNQSFSPSVITRTTEITKCSPSENGASSLDSNKNSISEKSKVFSQNCIKPVEEIVHSETKLEQVVCSYQKPSRTTESPSRVFTEEAKDSLNTSENDSEHQTNVTRSLFEHEGACSLKSSCCPPSVLSGVVQMPESTVTSTVGDKKTDQMVFHLETNSNSESHDKRQSDNILCSEDSGFVPVEKTPNLVNSVTSNNCADDILKTDECSRTSISNCESADSTWQSSLDTNNNSHYQKKRMFSENEENVKRMKTSEQINENICVSLERQTAFLEQVRHLIQQEIYSINYELFDKKLKELNQRIGKTECRNKHEGIADKLLAKIAKLQRRIKTVLLFQRNCLKPNMLSSNGASK

SEQ ID NO: 1702 - protein, 74 aa, Homo sapiens
  Payload ID: 469;
  Gene Symbol: ATF7IP2;
  Gene Name: activating transcription factor 7 interacting prt 2;
  ENSP ID: ENSP00000456023
MASPDRSKRKILKAKKTMPLSCRKQVEMLNKSRNVEALKTAIGSNVPSGNQSFSPSVITRTTEITKCSPSENGA

SEQ ID NO: 1703 - protein, 84 aa, Homo sapiens
  Payload ID: 469;
  Gene Symbol: ATF7IP2;
  Gene Name: activating transcription factor 7 interacting prt 2;
  ENSP ID: ENSP00000457731
MASPDRSKRKILKAKKTMPLSCRKQVEMLNKSRNVEALKTAIGSNVPSGNQSFSPSVITRTTEITKCSPSENGASSLDSNKNSI

SEQ ID NO: 1704 - protein, 17 aa, Homo sapiens
  Payload ID: 469;
  Gene Symbol: ATF7IP2;
  Gene Name: activating transcription factor 7 interacting prt 2;
  ENSP ID: ENSP00000461383
MASPDRSKRKILKAKKT

SEQ ID NO: 1705 - protein, 198 aa, Homo sapiens [sequence omitted]

SEQ ID NO: 1706 - protein, 144 aa, Homo sapiens
  Payload ID: 470;
  Gene Symbol: AICDA;
  Gene Name: activation-induced cytidine deaminase;
  ENSP ID: ENSP00000439103
  MOD_RES (1)..(1): Any amino acid
XSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKAPV

SEQ ID NO: 1707 - protein, 68 aa, Homo sapiens
  Payload ID: 470;
  Gene Symbol: AICDA;
  Gene Name: activation-induced cytidine deaminase;
  ENSP ID: ENSP00000439538
  MOD_RES (1)..(1): Any amino acid
XSLLMNRRKFLYQFKNVRWAKGRRETYLCYVVKRRDSATSFSLDFGYLRNKPLYEVDDLRDAFRTLGL

SEQ ID NO: 1708 - protein, 197 aa, Homo sapiens
  Payload ID: 470;
  Gene Symbol: AICDA;
  Gene Name: activation-induced cytidine deaminase;
  ENSP ID: ENSP00000443060
  MOD_RES (1)..(1): Any amino acid
XSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILLPLYEVDDLRDAFRTLGL

SEQ ID NO: 1709 - protein, 188 aa, Homo sapiens
  Payload ID: 470;
  Gene Symbol: AICDA;
  Gene Name: activation-induced cytidine deaminase;
  Uniprot ID:  Q9GZX7;
  ENSP ID: ENSP00000445691
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKENHERTFKAWEGLHENSVRLSRQLRRILLPLYEVDDLRDAFRTLGL

SEQ ID NO: 1710 - protein, 272 aa, Homo sapiens
  Payload ID: 471;
  Gene Symbol: ABT1;
  Gene Name: activator of basal transcription 1;
  Uniprot ID:  Q9ULW3;
  ENSP ID: ENSP00000274849
MEAEESEKAATEQEPLEGTEQTLDAEEEQEESEEAACGSKKRVVPGIVYLGHIPPRFRPLHVRNLLSAYGEVGRVFFQAEDRFVRRKKKAAAAAGGKKRSYTKDYTEGWVEFRDKRIAKRVAASLHNTPMGARRRSPFRYDLWNLKYLHRFTWSHLSEHLAFERQVRRQRLRAEVAQAKRETDFYLQSVERGQRFLAADGDPARPDGSWTFAQRPTEQELRARKAARPGGRERARLATAQDKARSNKGLLARIFGAPPPSESMEGPSLVRDS

SEQ ID NO: 1711 - protein, 822 aa, Homo sapiens
  Payload ID: 472;
  Gene Symbol: ABR;
  Gene Name: active BCR-related;
  Uniprot ID:  Q12979;
  ENSP ID: ENSP00000291107
MEEEEEAIGLLDKVLEDEDVFLLEECELGTPTSPGSGSPFLVAVKVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 1712 - protein, 859 aa, Homo sapiens
  Payload ID: 472;
  Gene Symbol: ABR;
  Gene Name: active BCR-related;
  Uniprot ID:  Q12979;
  ENSP ID: ENSP00000303909
MEPLSHRGLPRLSWIDTLYSNFSYGTDEYDGEGNEEQKGPPEGSETMPYIDESPTMSPQLSARSQGGGDGVSPTPPEGLAPGVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 1713 - protein, 641 aa, Homo sapiens
  Payload ID: 472;
  Gene Symbol: ABR;
  Gene Name: active BCR-related;
  ENSP ID: ENSP00000437429
MEILLIIRFCCNCTYALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 1714 - protein, 813 aa, Homo sapiens
  Payload ID: 472;
  Gene Symbol: ABR;
  Gene Name: active BCR-related;
  Uniprot ID:  Q12979;
  ENSP ID: ENSP00000442048
MPYIDESPTMSPQLSARSQGGGDGVSPTPPEGLAPGVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 1715 - protein, 310 aa, Homo sapiens
  Payload ID: 472;
  Gene Symbol: ABR;
  Gene Name: active BCR-related;
  Uniprot ID:  Q12979;
  ENSP ID: ENSP00000445198
MTDVLPQPDCSPKAGREPLALEESGSKRPPNTGARLWGRVRNKLLRNKLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 1716 - protein, 189 aa, Homo sapiens
  Payload ID: 472;
  Gene Symbol: ABR;
  Gene Name: active BCR-related;
  ENSP ID: ENSP00000458294
  MOD_RES (1)..(1): Any amino acid
XKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDLYCTLEVDSFGYFVSKAKTRVFRDTA

SEQ ID NO: 1717 - protein, 165 aa, Homo sapiens
  Payload ID: 472;
  Gene Symbol: ABR;
  Gene Name: active BCR-related;
  ENSP ID: ENSP00000459118
MEILLIIRFCCNCTYGNPALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDM

SEQ ID NO: 1718 - protein, 86 aa, Homo sapiens
  Payload ID: 472;
  Gene Symbol: ABR;
  Gene Name: active BCR-related;
  ENSP ID: ENSP00000459406
MPYIDESPTMSPQLSARSQGGGDGVSPTPPEGLAPGVEAGKGLEMRKLVLSGFLASEEIYINQLEALLLPMKPLKATATTSQPVLT

SEQ ID NO: 1719 - protein, 153 aa, Homo sapiens
  Payload ID: 472;
  Gene Symbol: ABR;
  Gene Name: active BCR-related;
  ENSP ID: ENSP00000459553
MTDVLPQPDCSPKAGREPLALEESGSKRPPNTGARLWGRVRNKLLRNKLDPQTVETKNWHTDVIEMNGIKVEFSMKFTSRDMSLKRTPSKKQTGVFGVKISVVTKRERSKVPYIVRQCVEEAVRLLRKHHRLNGGGMHMPRWVSRVAGRQLSS

SEQ ID NO: 1720 - protein, 88 aa, Homo sapiens
  Payload ID: 472;
  Gene Symbol: ABR;
  Gene Name: active BCR-related;
  ENSP ID: ENSP00000459761
MPYIDESPTMSPQLSARSQGGGDGVSPTPPEGLAPGVEAGKGLEMRKLVLSGFLASEEIYINQLEALLLPMKPLKATATTSQPVLTIQ

SEQ ID NO: 1721 - protein, 168 aa, Homo sapiens
  Payload ID: 472;
  Gene Symbol: ABR;
  Gene Name: active BCR-related;
  ENSP ID: ENSP00000459820
MRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTP

SEQ ID NO: 1722 - protein, 117 aa, Homo sapiens
  Payload ID: 472;
  Gene Symbol: ABR;
  Gene Name: active BCR-related;
  ENSP ID: ENSP00000460248
  MOD_RES (1)..(1): Any amino acid
XRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKWPVWI

SEQ ID NO: 1723 - protein, 133 aa, Homo sapiens
  Payload ID: 472;
  Gene Symbol: ABR;
  Gene Name: active BCR-related;
  ENSP ID: ENSP00000460770
MPYIDESPTMSPQLSARSQGGGDGVSPTPPEGLAPGPMKPLKATATTSQPVLTIQQIETIFYKIQDIYEIHKEFYDNLCPKVQQWDSQVTMGHLFQKLASQLGVYKAFVDNYKVALETAEKCSQSNNQFQKIS

SEQ ID NO: 1724 - protein, 813 aa, Homo sapiens; identical to SEQ ID NO: 1714
  Payload ID: 472;
  Gene Symbol: ABR;
  Gene Name: active BCR-related;
  Uniprot ID:  Q12979;
  ENSP ID: ENSP00000461565

SEQ ID NO: 1725 - protein, 129 aa, Homo sapiens
  Payload ID: 472;
  Gene Symbol: ABR;
  Gene Name: active BCR-related;
  ENSP ID: ENSP00000461629
MPYIDESPTMSPQLSARSQGGGDGVSPTPPEGLAPGVEAGKGLEMRKLVLSGFLASEEIYINQLEALLLPMKPLKATATTSQPVLTIQQIETIFYKIQDIYEIHKEFYDNLCPKVQQWDSQVTMGHLFQ

SEQ ID NO: 1726 - protein, 191 aa, Homo sapiens
  Payload ID: 472;
  Gene Symbol: ABR;
  Gene Name: active BCR-related;
  ENSP ID: ENSP00000461795
  MOD_RES (1)..(1): Any amino acid
XEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQNSSGTHCTSPPTCSPRQGGCGRVVEPAPPAWGPTQT

SEQ ID NO: 1727 - protein, 813 aa, Homo sapiens; identical to SEQ ID NO: 1714
  Payload ID: 472;
  Gene Symbol: ABR;
  Gene Name: active BCR-related;
  Uniprot ID:  Q12979;
  ENSP ID: ENSP00000478880

SEQ ID NO: 1728 - protein, 310 aa, Homo sapiens; identical to SEQ ID NO: 1715
  Payload ID: 472;
  Gene Symbol: ABR;
  Gene Name: active BCR-related;
  Uniprot ID:  Q12979;
  ENSP ID: ENSP00000479455

SEQ ID NO: 1729 - protein, 641 aa, Homo sapiens; identical to SEQ ID NO: 1713
  Payload ID: 472;
  Gene Symbol: ABR;
  Gene Name: active BCR-related;
  ENSP ID: ENSP00000480343

SEQ ID NO: 1730 - protein, 777 aa, Homo sapiens
  Payload ID: 472;
  Gene Symbol: ABR;
  Gene Name: active BCR-related;
  ENSP ID: ENSP00000480982
VEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 1731 - protein, 859 aa, Homo sapiens; identical to SEQ ID NO: 1712
  Payload ID: 472;
  Gene Symbol: ABR;
  Gene Name: active BCR-related;
  Uniprot ID:  Q12979;
  ENSP ID: ENSP00000481740

SEQ ID NO: 1732 - protein, 822 aa, Homo sapiens; identical to SEQ ID NO: 1711
  Payload ID: 472;
  Gene Symbol: ABR;
  Gene Name: active BCR-related;
  Uniprot ID:  Q12979;
  ENSP ID: ENSP00000483168

SEQ ID NO: 1733 - protein, 310 aa, Homo sapiens; identical to SEQ ID NO: 1715
  Payload ID: 472;
  Gene Symbol: ABR;
  Gene Name: active BCR-related;
  Uniprot ID:  Q12979;
  ENSP ID: ENSP00000484030

SEQ ID NO: 1734 - protein, 777 aa, Homo sapiens; identical to SEQ ID NO: 1730
  Payload ID: 472;
  Gene Symbol: ABR;
  Gene Name: active BCR-related;
  ENSP ID: ENSP00000484899

SEQ ID NO: 1735 - protein, 129 aa, Homo sapiens; identical to SEQ ID NO: 1725
  Payload ID: 472;
  Gene Symbol: ABR;
  Gene Name: active BCR-related;
  ENSP ID: ENSP00000485727

SEQ ID NO: 1736 - protein, 165 aa, Homo sapiens; identical to SEQ ID NO: 1717
  Payload ID: 472;
  Gene Symbol: ABR;
  Gene Name: active BCR-related;
  ENSP ID: ENSP00000485918

SEQ ID NO: 1737 - protein, 189 aa, Homo sapiens; identical to SEQ ID NO: 1716
  Payload ID: 472;
  Gene Symbol: ABR;
  Gene Name: active BCR-related;
  ENSP ID: ENSP00000485949
  MOD_RES (1)..(1): Any amino acid

SEQ ID NO: 1738 - protein, 50 aa, Homo sapiens
  Payload ID: 472;
  Gene Symbol: ABR;
  Gene Name: active BCR-related;
  ENSP ID: ENSP00000485981
VEAGKGLEMRKLVLSGFLASEEIYINQLEALLLPMKPLKATATTSQPVLT

SEQ ID NO: 1739 - protein, 191 aa, Homo sapiens; identical to SEQ ID NO: 1726
  Payload ID: 472;
  Gene Symbol: ABR;
  Gene Name: active BCR-related;
  ENSP ID: ENSP00000486137
  MOD_RES (1)..(1): Any amino acid

SEQ ID NO: 1740 - protein, 93 aa, Homo sapiens
  Payload ID: 472;
  Gene Symbol: ABR;
  Gene Name: active BCR-related;
  ENSP ID: ENSP00000486156
VEAGKGLEMRKLVLSGFLASEEIYINQLEALLLPMKPLKATATTSQPVLTIQQIETIFYKIQDIYEIHKEFYDNLCPKVQQWDSQVTMGHLFQ

SEQ ID NO: 1741 - protein, 133 aa, Homo sapiens; identical to SEQ ID NO: 1723
  Payload ID: 472;
  Gene Symbol: ABR;
  Gene Name: active BCR-related;
  ENSP ID: ENSP00000486157

SEQ ID NO: 1742 - protein, 813 aa, Homo sapiens; identical to SEQ ID NO: 1714
  Payload ID: 472;
  Gene Symbol: ABR;
  Gene Name: active BCR-related;
  Uniprot ID:  Q12979;
  ENSP ID: ENSP00000486214

SEQ ID NO: 1743 - protein, 168 aa, Homo sapiens; identical to SEQ ID NO: 1721
  Payload ID: 472;
  Gene Symbol: ABR;
  Gene Name: active BCR-related;
  ENSP ID: ENSP00000486258

SEQ ID NO: 1744 - protein, 822 aa, Homo sapiens; identical to SEQ ID NO: 1711
  Payload ID: 472;
  Gene Symbol: ABR;
  Gene Name: active BCR-related;
  Uniprot ID:  Q12979;
  ENSP ID: ENSP00000486511

SEQ ID NO: 1745 - protein, 168 aa, Homo sapiens; identical to SEQ ID NO: 1721
  Payload ID: 472;
  Gene Symbol: ABR;
  Gene Name: active BCR-related;
  ENSP ID: ENSP00000486545

SEQ ID NO: 1746 - protein, 20 aa, Homo sapiens
  Payload ID: 472;
  Gene Symbol: ABR;
  Gene Name: active BCR-related;
  ENSP ID: ENSP00000486625
ETKNWHTDVIEMNGVSRGWE

SEQ ID NO: 1747 - protein, 153 aa, Homo sapiens; identical to SEQ ID NO: 1719
  Payload ID: 472;
  Gene Symbol: ABR;
  Gene Name: active BCR-related;
  ENSP ID: ENSP00000486789

SEQ ID NO: 1748 - protein, 97 aa, Homo sapiens
  Payload ID: 472;
  Gene Symbol: ABR;
  Gene Name: active BCR-related;
  ENSP ID: ENSP00000486808
PMKPLKATATTSQPVLTIQQIETIFYKIQDIYEIHKEFYDNLCPKVQQWDSQVTMGHLFQKLASQLGVYKAFVDNYKVALETAEKCSQSNNQFQKIS

SEQ ID NO: 1749 - protein, 86 aa, Homo sapiens; identical to SEQ ID NO: 1718
  Payload ID: 472;
  Gene Symbol: ABR;
  Gene Name: active BCR-related;
  ENSP ID: ENSP00000486817

SEQ ID NO: 1750 - protein, 777 aa, Homo sapiens; identical to SEQ ID NO: 1730
  Payload ID: 472;
  Gene Symbol: ABR;
  Gene Name: active BCR-related;
  ENSP ID: ENSP00000486868

SEQ ID NO: 1751 - protein, 117 aa, Homo sapiens; identical to SEQ ID NO: 1722
  Payload ID: 472;
  Gene Symbol: ABR;
  Gene Name: active BCR-related;
  ENSP ID: ENSP00000486946
  MOD_RES (1)..(1): Any amino acid

SEQ ID NO: 1752 - protein, 52 aa, Homo sapiens
  Payload ID: 472;
  Gene Symbol: ABR;
  Gene Name: active BCR-related;
  ENSP ID: ENSP00000487120
VEAGKGLEMRKLVLSGFLASEEIYINQLEALLLPMKPLKATATTSQPVLTIQ

SEQ ID NO: 1753 - protein, 153 aa, Homo sapiens; identical to SEQ ID NO: 1719
  Payload ID: 472;
  Gene Symbol: ABR;
  Gene Name: active BCR-related;
  ENSP ID: ENSP00000487341

SEQ ID NO: 1754 - protein, 165 aa, Homo sapiens; identical to SEQ ID NO: 1717
  Payload ID: 472;
  Gene Symbol: ABR;
  Gene Name: active BCR-related;
  ENSP ID: ENSP00000487381

SEQ ID NO: 1755 - protein, 49 aa, Homo sapiens
  Payload ID: 472;
  Gene Symbol: ABR;
  Gene Name: active BCR-related;
  ENSP ID: ENSP00000487388
GKSYLFLLSSDYERSEWREAIQKLQKKGKFLPLPRSPMMSVALMGLLYF

SEQ ID NO: 1756 - protein, 641 aa, Homo sapiens; identical to SEQ ID NO: 1713
  Payload ID: 472;
  Gene Symbol: ABR;
  Gene Name: active BCR-related;
  ENSP ID: ENSP00000487391

SEQ ID NO: 1757 - protein, 88 aa, Homo sapiens; identical to SEQ ID NO: 1720
  Payload ID: 472;
  Gene Symbol: ABR;
  Gene Name: active BCR-related;
  ENSP ID: ENSP00000487433

SEQ ID NO: 1758 - protein, 191 aa, Homo sapiens; identical to SEQ ID NO: 1726
  Payload ID: 472;
  Gene Symbol: ABR;
  Gene Name: active BCR-related;
  ENSP ID: ENSP00000487454
  MOD_RES (1)..(1): Any amino acid

SEQ ID NO: 1759 - protein, 117 aa, Homo sapiens; identical to SEQ ID NO: 1722
  Payload ID: 472;
  Gene Symbol: ABR;
  Gene Name: active BCR-related;
  ENSP ID: ENSP00000487459
  MOD_RES (1)..(1): Any amino acid

SEQ ID NO: 1760 - protein, 20 aa, Homo sapiens
  Payload ID: 472;
  Gene Symbol: ABR;
  Gene Name: active BCR-related;
  ENSP ID: ENSP00000487515
ETKNWHTDVIEMNGVSRGWE

SEQ ID NO: 1761 - protein, 49 aa, Homo sapiens
  Payload ID: 472;
  Gene Symbol: ABR;
  Gene Name: active BCR-related;
  ENSP ID: ENSP00000487565
GKSYLFLLSSDYERSEWREAIQKLQKKGKFLPLPRSPMMSVALMGLLFF

SEQ ID NO: 1762 - protein, 503 aa, Homo sapiens
  Payload ID: 473;
  Gene Symbol: ACVRL1;
  Gene Name: activin A receptor type II-like 1;
  Uniprot ID:  P37023;
  ENSP ID: ENSP00000373574
MTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 1763 - protein, 329 aa, Homo sapiens
  Payload ID: 473;
  Gene Symbol: ACVRL1;
  Gene Name: activin A receptor type II-like 1;
  ENSP ID: ENSP00000392492
MALTPPLLLLSAGTMTLGSPRKGLLMLLMALVTQGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 1764 - protein, 159 aa, Homo sapiens
  Payload ID: 473;
  Gene Symbol: ACVRL1;
  Gene Name: activin A receptor type II-like 1;
  ENSP ID: ENSP00000446724
MALTPPLLLLSAGTMTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEGKGRYGEVWRGLWHGESVAVKIFSSRDEQSWFRETEIYNTV

SEQ ID NO: 1765 - protein, 517 aa, Homo sapiens
  Payload ID: 473;
  Gene Symbol: ACVRL1;
  Gene Name: activin A receptor type II-like 1;
  ENSP ID: ENSP00000447884
MALTPPLLLLSAGTMTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 1766 - protein, 89 aa, Homo sapiens
  Payload ID: 473;
  Gene Symbol: ACVRL1;
  Gene Name: activin A receptor type II-like 1;
  ENSP ID: ENSP00000455848
MTLGSPRKGLLMLLMALVTQGDPVKPSRGPLVTCTCESPHCKGPTCRGAWCTVVLVREEGRHPQEHRGCGNLHRELCRGRPTEFVNHYC

SEQ ID NO: 1767 - protein, 163 aa, Homo sapiens
  Payload ID: 473;
  Gene Symbol: ACVRL1;
  Gene Name: activin A receptor type II-like 1;
  ENSP ID: ENSP00000457394
  MOD_RES (1)..(1): Any amino acid
XSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVRPLLGLGWRGVVAHGWDFWAQELVSEASASSHRY

SEQ ID NO: 1768 - protein, 509 aa, Homo sapiens
  Payload ID: 474;
  Gene Symbol: ACVR1;
  Gene Name: activin A receptor, type I;
  Uniprot ID:  Q04771;
  ENSP ID: ENSP00000263640
MVDGVMILPVLIMIALPSPSMEDEKPKVNPKLYMCVCEGLSCGNEDHCEGQQCFSSLSINDGFHVYQKGCFQVYEQGKMTCKTPPSPGQAVECCQGDWCNRNITAQLPTKGKSFPGTQNFHLEVGLIILSVVFAVCLLACLLGVALRKFKRRNQERLNPRDVEYGTIEGLITTNVGDSTLADLLDHSCTSGSGSGLPFLVQRTVARQITLLECVGKGRYGEVWRGSWQGENVAVKIFSSRDEKSWFRETELYNTVMLRHENILGFIASDMTSRHSSTQLWLITHYHEMGSLYDYLQLTTLDTVSCLRIVLSIASGLAHLHIEIFGTQGKPAIAHRDLKSKNILVKKNGQCCIADLGLAVMHSQSTNQLDVGNNPRVGTKRYMAPEVLDETIQVDCFDSYKRVDIWAFGLVLWEVARRMVSNGIVEDYKPPFYDVVPNDPSFEDMRKVVCVDQQRPNIPNRWFSDPTLTSLAKLMKECWYQNPSARLTALRIKKTLTKIDNSLDKLKTDC

SEQ ID NO: 1769 - protein, 509 aa, Homo sapiens; identical to SEQ ID NO: 1768
  Payload ID: 474;
  Gene Symbol: ACVR1;
  Gene Name: activin A receptor, type I;
  Uniprot ID:  Q04771;
  ENSP ID: ENSP00000387127

SEQ ID NO: 1770 - protein, 509 aa, Homo sapiens; identical to SEQ ID NO: 1768
  Payload ID: 474;
  Gene Symbol: ACVR1;
  Gene Name: activin A receptor, type I;
  Uniprot ID:  Q04771;
  ENSP ID: ENSP00000387273

SEQ ID NO: 1771 - protein, 21 aa, Homo sapiens
  Payload ID: 474;
  Gene Symbol: ACVR1;
  Gene Name: activin A receptor, type I;
  ENSP ID: ENSP00000399322
MVDGVMILPVLIMIALPSPSM

SEQ ID NO: 1772 - protein, 71 aa, Homo sapiens
  Payload ID: 474;
  Gene Symbol: ACVR1;
  Gene Name: activin A receptor, type I;
  ENSP ID: ENSP00000400767
MVDGVMILPVLIMIALPSPSMEDEKPKVNPKLYMCVCEGLSCGNEDHCEGQQCFSSLSINDGFHVYQKGCF

SEQ ID NO: 1773 - protein, 86 aa, Homo sapiens
  Payload ID: 474;
  Gene Symbol: ACVR1;
  Gene Name: activin A receptor, type I;
  ENSP ID: ENSP00000401189
MVDGVMILPVLIMIALPSPSMEDEKPKVNPKLYMCVCEGLSCGNEDHCEGQQCFSSLSINDGFHVYQKGCFQVYEQGKMTCKTPPS

SEQ ID NO: 1774 - protein, 87 aa, Homo sapiens
  Payload ID: 474;
  Gene Symbol: ACVR1;
  Gene Name: activin A receptor, type I;
  ENSP ID: ENSP00000403006
MVDGVMILPVLIMIALPSPSMEDEKPKVNPKLYMCVCEGLSCGNEDHCEGQQCFSSLSINDGFHVYQKGCFQVYEQGKMTCKTPPSP

SEQ ID NO: 1775 - protein, 509 aa, Homo sapiens; identical to SEQ ID NO: 1768
  Payload ID: 474;
  Gene Symbol: ACVR1;
  Gene Name: activin A receptor, type I;
  Uniprot ID:  Q04771;
  ENSP ID: ENSP00000405004

SEQ ID NO: 1776 - protein, 72 aa, Homo sapiens
  Payload ID: 474;
  Gene Symbol: ACVR1;
  Gene Name: activin A receptor, type I;
  ENSP ID: ENSP00000440091
MVDGVMILPVLIMIALPSPSMEDEKPKVNPKLYMCVCEGLSCGNEDHCEGQQCFSSLSINDGFHVYQKGCFQ

SEQ ID NO: 1777 - protein, 505 aa, Homo sapiens
  Payload ID: 475;
  Gene Symbol: ACVR1B;
  Gene Name: activin A receptor, type IB;
  Uniprot ID:  P36896;
  ENSP ID: ENSP00000257963
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 1778 - protein, 476 aa, Homo sapiens
  Payload ID: 475;
  Gene Symbol: ACVR1B;
  Gene Name: activin A receptor, type IB;
  Uniprot ID:  P36896;
  ENSP ID: ENSP00000390477
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEVRSWPPAAFPSA

SEQ ID NO: 1779 - protein, 487 aa, Homo sapiens
  Payload ID: 475;
  Gene Symbol: ACVR1B;
  Gene Name: activin A receptor, type IB;
  Uniprot ID:  P36896;
  ENSP ID: ENSP00000397550
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGTFLFCLCSYLPFQDAGSPKAVLLPPFFLQPVGCLLPEPESSFKVAIKGVEVAVLRVRLFFRDQFVE

SEQ ID NO: 1780 - protein, 546 aa, Homo sapiens
  Payload ID: 475;
  Gene Symbol: ACVR1B;
  Gene Name: activin A receptor, type IB;
  Uniprot ID:  P36896;
  ENSP ID: ENSP00000442656
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKADCSFLTLPWEVVMVSAAPKLRSLRLQYKGGRGRARFLFPLNNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 1781 - protein, 453 aa, Homo sapiens
  Payload ID: 475;
  Gene Symbol: ACVR1B;
  Gene Name: activin A receptor, type IB;
  Uniprot ID:  P36896;
  ENSP ID: ENSP00000442885
MVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 1782 - protein, 71 aa, Homo sapiens
  Payload ID: 475;
  Gene Symbol: ACVR1B;
  Gene Name: activin A receptor, type IB;
  ENSP ID: ENSP00000443218
MVSIFNLDGMEHHVRTCIPKVELVPAGKPFYCLSSEDLRNTHCCYTDYCNRIDLRVPSGHLKEPEHPSMWG

SEQ ID NO: 1783 - protein, 493 aa, Homo sapiens
  Payload ID: 476;
  Gene Symbol: ACVR1C;
  Gene Name: activin A receptor, type IC;
  Uniprot ID:  Q8NER5;
  ENSP ID: ENSP00000243349
MTRALCSALRQALLLLAAAAELSPGLKCVCLLCDSSNFTCQTEGACWASVMLTNGKEQVIKSCVSLPELNAQVFCHSSNNVTKTECCFTDFCNNITLHLPTASPNAPKLGPMELAIIITVPVCLLSIAAMLTVWACQGRQCSYRKKKRPNVEEPLSECNLVNAGKTLKDLIYDVTASGSGSGLPLLVQRTIARTIVLQEIVGKGRFGEVWHGRWCGEDVAVKIFSSRDERSWFREAEIYQTVMLRHENILGFIAADNKDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 1784 - protein, 336 aa, Homo sapiens
  Payload ID: 476;
  Gene Symbol: ACVR1C;
  Gene Name: activin A receptor, type IC;
  Uniprot ID:  Q8NER5;
  ENSP ID: ENSP00000335139
MTRALCSALRQALLLLAAAAELSPGLKCVCLLCDSSNFTCQTEGACWASVMLTNGKEQVIKSCVSLPELNAQVFCHSSNNVTKTECCFTDFCNNITLHLPTDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 1785 - protein, 413 aa, Homo sapiens
  Payload ID: 476;
  Gene Symbol: ACVR1C;
  Gene Name: activin A receptor, type IC;
  Uniprot ID:  Q8NER5;
  ENSP ID: ENSP00000335178
MTRALCSALRQALLLLAAAAELSPGLKCVCLLCDSSNFTCQTEGACWASVMLTNGKEQVIKSCVSLPELNAQVFCHSSNNVTKTECCFTDFCNNITLHLPTGLPLLVQRTIARTIVLQEIVGKGRFGEVWHGRWCGEDVAVKIFSSRDERSWFREAEIYQTVMLRHENILGFIAADNKDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 1786 - protein, 443 aa, Homo sapiens
  Payload ID: 476;
  Gene Symbol: ACVR1C;
  Gene Name: activin A receptor, type IC;
  Uniprot ID:  Q8NER5;
  ENSP ID: ENSP00000387168
MLTNGKEQVIKSCVSLPELNAQVFCHSSNNVTKTECCFTDFCNNITLHLPTASPNAPKLGPMELAIIITVPVCLLSIAAMLTVWACQGRQCSYRKKKRPNVEEPLSECNLVNAGKTLKDLIYDVTASGSGSGLPLLVQRTIARTIVLQEIVGKGRFGEVWHGRWCGEDVAVKIFSSRDERSWFREAEIYQTVMLRHENILGFIAADNKDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 1787 - protein, 513 aa, Homo sapiens
  Payload ID: 477;
  Gene Symbol: ACVR2A;
  Gene Name: activin A receptor, type IIA;
  Uniprot ID:  P27037;
  ENSP ID: ENSP00000241416
MGAAAKLAFAVFLISCSSGAILGRSETQECLFFNANWEKDRTNQTGVEPCYGDKDKRRHCFATWKNISGSIEIVKQGCWLDDINCYDRTDCVEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINFQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 1788 - protein, 513 aa, Homo sapiens; identical to SEQ ID NO: 1787
  Payload ID: 477;
  Gene Symbol: ACVR2A;
  Gene Name: activin A receptor, type IIA;
  Uniprot ID:  P27037;
  ENSP ID: ENSP00000384338

SEQ ID NO: 1789 - protein, 405 aa, Homo sapiens
  Payload ID: 477;
  Gene Symbol: ACVR2A;
  Gene Name: activin A receptor, type IIA;
  Uniprot ID:  P27037;
  ENSP ID: ENSP00000439988
MCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINFQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 1790 - protein, 512 aa, Homo sapiens
  Payload ID: 478;
  Gene Symbol: ACVR2B;
  Gene Name: activin A receptor, type IIB;
  Uniprot ID:  Q13705;
  ENSP ID: ENSP00000340361
MTAPWVALALLWGSLCAGSGRGEAETRECIYYNANWELERTNQSGLERCEGEQDKRLHCYASWRNSSGTIELVKKGCWLDDFNCYDRQECVATEENPQVYFCCCEGNFCNERFTHLPEAGGPEVTYEPPPTAPTLLTVLAYSLLPIGGLSLIVLLAFWMYRHRKPPYGHVDIHEDPGPPPPSPLVGLKPLQLLEIKARGRFGCVWKAQLMNDFVAVKIFPLQDKQSWQSEREIFSTPGMKHENLLQFIAAEKRGSNLEVELWLITAFHDKGSLTDYLKGNIITWNELCHVAETMSRGLSYLHEDVPWCRGEGHKPSIAHRDFKSKNVLLKSDLTAVLADFGLAVRFEPGKPPGDTHGQVGTRRYMAPEVLEGAINFQRDAFLRIDMYAMGLVLWELVSRCKAADGPVDEYMLPFEEEIGQHPSLEELQEVVVHKKMRPTIKDHWLKHPGLAQLCVTIEECWDHDAEARLSAGCVEERVSLIRRSVNGTTSDCLVSLVTSVTNVDLPPKESSI

SEQ ID NO: 1791 - protein, 1102 aa, Homo sapiens
  Payload ID: 479;
  Gene Symbol: ADNP;
  Gene Name: activity-dependent neuroprotector homeobox;
  Uniprot ID:  Q9H2P0;
  ENSP ID: ENSP00000342905
MFQLPVNNLGSLRKARKTVKKILSDIGLEYCKEHIEDFKQFEPNDFYLKNTTWEDVGLWDPSLTKNQDYRTKPFCCSACPFSSKFFSAYKSHFRNVHSEDFENRILLNCPYCTFNADKKTLETHIKIFHAPNASAPSSSLSTFKDKNKNDGLKPKQADSVEQAVYYCKKCTYRDPLYEIVRKHIYREHFQHVAAPYIAKAGEKSLNGAVPLGSNAREESSIHCKRCLFMPKSYEALVQHVIEDHERIGYQVTAMIGHTNVVVPRSKPLMLIAPKPQDKKSMGLPPRIGSLASGNVRSLPSQQMVNRLSIPKPNLNSTGVNMMSSVHLQQNNYGVKSVGQGYSVGQSMRLGLGGNAPVSIPQQSQSVKQLLPSGNGRSYGLGSEQRSQAPARYSLQSANASSLSSGQLKSPSLSQSQASRVLGQSSSKPAAAATGPPPGNTSSTQKWKICTICNELFPENVYSVHFEKEHKAEKVPAVANYIMKIHNFTSKCLYCNRYLPTDTLLNHMLIHGLSCPYCRSTFNDVEKMAAHMRMVHIDEEMGPKTDSTLSFDLTLQQGSHTNIHLLVTTYNLRDAPAESVAYHAQNNPPVPPKPQPKVQEKADIPVKSSPQAAVPYKKDVGKTLCPLCFSILKGPISDALAHHLRERHQVIQTVHPVEKKLTYKCIHCLGVYTSNMTASTITLHLVHCRGVGKTQNGQDKTNAPSRLNQSPSLAPVKRTYEQMEFPLLKKRKLDDDSDSPSFFEEKPEEPVVLALDPKGHEDDSYEARKSFLTKYFNKQPYPTRREIEKLAASLWLWKSDIASHFSNKRKKCVRDCEKYKPGVLLGFNMKELNKVKHEMDFDAEWLFENHDEKDSRVNASKTADKKLNLGKEDDSSSDSFENLEEESNESGSPFDPVFEVEPKISNDNPEEHVLKVIPEDASESEEKLDQKEDGSKYETIHLTEEPTKLMHNASDSEVDQDDVVEWKDGASPSESGPGSQQVSDFEDNTCEMKPGTWSDESSQSEDARSSKPAAKKKATMQGDREQLKWKNSSYGKVEGFWSKDQSQWKNASENDERLSNPQIEWQNSTIDSEDGEQFDNMTDGVAEPMHGSLAGVKLSSQQA

SEQ ID NO: 1792 - protein, 1102 aa, Homo sapiens; identical to SEQ ID NO: 1791
  Payload ID: 479;
  Gene Symbol: ADNP;
  Gene Name: activity-dependent neuroprotector homeobox;
  Uniprot ID:  Q9H2P0;
  ENSP ID: ENSP00000360662

SEQ ID NO: 1793 - protein, 1102 aa, Homo sapiens; identical to SEQ ID NO: 1791
  Payload ID: 479;
  Gene Symbol: ADNP;
  Gene Name: activity-dependent neuroprotector homeobox;
  Uniprot ID:  Q9H2P0;
  ENSP ID: ENSP00000379346

SEQ ID NO: 1794 - protein, 1102 aa, Homo sapiens; identical to SEQ ID NO: 1791
  Payload ID: 479;
  Gene Symbol: ADNP;
  Gene Name: activity-dependent neuroprotector homeobox;
  Uniprot ID:  Q9H2P0;
  ENSP ID: ENSP00000379349

SEQ ID NO: 1795 - protein, 172 aa, Homo sapiens
  Payload ID: 479;
  Gene Symbol: ADNP;
  Gene Name: activity-dependent neuroprotector homeobox;
  ENSP ID: ENSP00000436181
MFQLPVNNLGSLRKARKTVKKILSDIGLEYCKEHIEDFKQFEPNDFYLKNTTWEDVGLWDPSLTKNQDYRTKPFCCSACPFSSKFFSAYKSHFRNVHSEDFENRILLNCPYCTFNADKKTLETHIKIFHAPNASAPSSSLSTFKDKNKNDGLKPKQADSVEQAVYYCKKCTY

SEQ ID NO: 1796 - protein, 1102 aa, Homo sapiens; identical to SEQ ID NO: 1791
  Payload ID: 479;
  Gene Symbol: ADNP;
  Gene Name: activity-dependent neuroprotector homeobox;
  Uniprot ID:  Q9H2P0;
  ENSP ID: ENSP00000483881

SEQ ID NO: 1797 - protein, 396 aa, Homo sapiens
  Payload ID: 480;
  Gene Symbol: ARC;
  Gene Name: activity-regulated cytoskeleton-associated prt;
  Uniprot ID:  Q7LC44;
  ENSP ID: ENSP00000349022
MELDHRTSGGLHAYPGPRGGQVAKPNVILQIGKCRAEMLEHVRRTHRHLLAEVSKQVERELKGLHRSVGKLESNLDGYVPTSDSQRWKKSIKACLCRCQETIANLERWVKREMHVWREVFYRLERWADRLESTGGKYPVGSESARHTVSVGVGGPESYCHEADGYDYTVSPYAITPPPAAGELPGQEPAEAQQYQPWVPGEDGQPSPGVDTQIFEDPREFLSHLEEYLRQVGGSEEYWLSQIQNHMNGPAKKWWEFKQGSVKNWVEFKKEFLQYSEGTLSREAIQRELDLPQKQGEPLDQFLWRKRDLYQTLYVDADEEEIIQYVVGTLQPKLKRFLRHPLPKTLEQLIQRGMEVQDDLEQAAEPAGPHLPVEDEAETLTPAPNSESVASDRTQPE

SEQ ID NO: 1798 - protein, 732 aa, Homo sapiens
  Payload ID: 481;
  Gene Symbol: APEH;
  Gene Name: acylaminoacyl-peptide hydrolase;
  Uniprot ID:  P13798;
  ENSP ID: ENSP00000296456
MERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 1799 - protein, 50 aa, Homo sapiens
  Payload ID: 481;
  Gene Symbol: APEH;
  Gene Name: acylaminoacyl-peptide hydrolase;
  ENSP ID: ENSP00000401871
MERQVLLSEPEEAAALYRGLSRQPALSAACLGPEVTTQYGGQYRTVHTDC

SEQ ID NO: 1800 - protein, 308 aa, Homo sapiens
  Payload ID: 481;
  Gene Symbol: APEH;
  Gene Name: acylaminoacyl-peptide hydrolase;
  ENSP ID: ENSP00000402365
TPRLAPAAERRLWNVRLLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQR

SEQ ID NO: 1801 - protein, 54 aa, Homo sapiens
  Payload ID: 481;
  Gene Symbol: APEH;
  Gene Name: acylaminoacyl-peptide hydrolase;
  ENSP ID: ENSP00000404353
TAEQRVSFRHHESCAAQGWRHGPWGREAVPGGLGEEPEAQELQPVSAGETWACL

SEQ ID NO: 1802 - protein, 58 aa, Homo sapiens
  Payload ID: 481;
  Gene Symbol: APEH;
  Gene Name: acylaminoacyl-peptide hydrolase;
  ENSP ID: ENSP00000410149
MERQTAEQRVSFRHHESCAAQGWRHGPWGREAVPGGLGEEPEAQELQPVSAGETWACL

SEQ ID NO: 1803 - protein, 284 aa, Homo sapiens
  Payload ID: 481;
  Gene Symbol: APEH;
  Gene Name: acylaminoacyl-peptide hydrolase;
  ENSP ID: ENSP00000410366
QVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKAFWAPGDAGVVFVGWWHEPFRLGIRFCTNRRSALYYVDLIGGKCELLSDDSLAVSSPRLSPDQCRIVYLQYPSLIPHHQCSQLCL

SEQ ID NO: 1804 - protein, 232 aa, Homo sapiens
  Payload ID: 481;
  Gene Symbol: APEH;
  Gene Name: acylaminoacyl-peptide hydrolase;
  ENSP ID: ENSP00000414369
MKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCL

SEQ ID NO: 1805 - protein, 737 aa, Homo sapiens
  Payload ID: 481;
  Gene Symbol: APEH;
  Gene Name: acylaminoacyl-peptide hydrolase;
  ENSP ID: ENSP00000415862
MERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDCSVSCRCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 1806 - protein, 47 aa, Homo sapiens
  Payload ID: 481;
  Gene Symbol: APEH;
  Gene Name: acylaminoacyl-peptide hydrolase;
  ENSP ID: ENSP00000438180
QRVVFDSAQRSRQDLFAVDTQVGAGSCSQLTRTSWWHSFPHPAYLQP

SEQ ID NO: 1807 - protein, 528 aa, Homo sapiens
  Payload ID: 482;
  Gene Symbol: ACBD3;
  Gene Name: acyl-CoA binding domain containing 3;
  Uniprot ID:  Q9H3P7;
  ENSP ID: ENSP00000355777
MAAVLNAERLEVSVDGLTLSPDPEERPGAEGAPLLPPPLPPPSPPGSGRGPGASGEQPEPGEAAAGGAAEEARRLEQRWGFGLEELYGLALRFFKEKDGKAFHPTYEEKLKLVALHKQVLMGPYNPDTCPEVGFFDVLGNDRRREWAALGNMSKEDAMVEFVKLLNRCCHLFSTYVASHKIEKEEQEKKRKEEEERRRREEEERERLQKEEEKRRREEEERLRREEEERRRIEEERLRLEQQKQQIMAALNSQTAVQFQQYAAQQYPGNYEQQQILIRQLQEQHYQQYMQQLYQVQLAQQQAALQKQQEVVVAGSSLPTSSKVNATVPSNMMSVNGQAKTHTDSSEKELEPEAAEEALENGPKESLPVIAAPSMWTRPQIKDFKEKIQQDADSVITVGRGEVVTVRVPTHEEGSYLFWEFATDNYDIGFGVYFEWTDSPNTAVSVHVSESSDDDEEEEENIGCEEKAKKNANKPLLDEIVPVYRRDCHEEVYAGSHQYPGRGVYLLKFDNSYSLWRSKSVYYRVYYTR

SEQ ID NO: 1808 - protein, 305 aa, Homo sapiens
  Payload ID: 483;
  Gene Symbol: ACBD4;
  Gene Name: acyl-CoA binding domain containing 4;
  Uniprot ID:  Q8NC06;
  ENSP ID: ENSP00000314440
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPESHSPRDLDSEVFCDSLEQLEPELVWTEQRAASGGKRDPRNSPVPPTKKEGLRGSPPGPQELDVWLLGTVRALQESMQEVQARVQSLESMPRPPEQRPQPRPSARPWPLGLPGPALLFFLLWPFVVQWLFRMFRTQKR

SEQ ID NO: 1809 - protein, 268 aa, Homo sapiens
  Payload ID: 483;
  Gene Symbol: ACBD4;
  Gene Name: acyl-CoA binding domain containing 4;
  Uniprot ID:  Q8NC06;
  ENSP ID: ENSP00000366154
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPESHSPRDLDSEVFCDSLEQLEPELSSGQHLEESVIPGTAPCPPQRKRGCGAARRGPRSWTCGCWGQFEHYRRACRRCRRGCRAWRACPGPLSSLTLSVRLE

SEQ ID NO: 1810 - protein, 305 aa, Homo sapiens; identical to SEQ ID NO: 1808
  Payload ID: 483;
  Gene Symbol: ACBD4;
  Gene Name: acyl-CoA binding domain containing 4;
  Uniprot ID:  Q8NC06;
  ENSP ID: ENSP00000381367

SEQ ID NO: 1811 - protein, 341 aa, Homo sapiens
  Payload ID: 483;
  Gene Symbol: ACBD4;
  Gene Name: acyl-CoA binding domain containing 4;
  Uniprot ID:  Q8NC06;
  ENSP ID: ENSP00000405969
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPASLWAVTLPTPPQSPIHPGTWTPRFSVIPWSSWSLSWFGQSSGQHLEESVIPGTAPCPPQRKRGCGAARRGPRSWTCGCWGQFEHYRRACRRCRRGCRAWRACPGPLSRGRSPGPVLGHGPLGSRGPRCSSSSCGPSSSSGSSECFGPKRGDCQWRGLCSQLRLSCCALSLPRV

SEQ ID NO: 1812 - protein, 341 aa, Homo sapiens; identical to SEQ ID NO: 1811
  Payload ID: 483;
  Gene Symbol: ACBD4;
  Gene Name: acyl-CoA binding domain containing 4;
  Uniprot ID:  Q8NC06;
  ENSP ID: ENSP00000465484

SEQ ID NO: 1813 - protein, 341 aa, Homo sapiens; identical to SEQ ID NO: 1811
  Payload ID: 483;
  Gene Symbol: ACBD4;
  Gene Name: acyl-CoA binding domain containing 4;
  Uniprot ID:  Q8NC06;
  ENSP ID: ENSP00000465610

SEQ ID NO: 1814 - protein, 269 aa, Homo sapiens
  Payload ID: 483;
  Gene Symbol: ACBD4;
  Gene Name: acyl-CoA binding domain containing 4;
  ENSP ID: ENSP00000466305
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPESHSPRDLDSEVFCDSLEQLEPELVWTEQRAASGGKRDPRNSPVPPTKKEAAAQAQCSAMAPWAPGARAALLPPVALRRPVALPNVSDPKEVTVSGGVSAAN

SEQ ID NO: 1815 - protein, 38 aa, Homo sapiens
  Payload ID: 483;
  Gene Symbol: ACBD4;
  Gene Name: acyl-CoA binding domain containing 4;
  ENSP ID: ENSP00000466505
MGTEKESPEPDCQKQFQAAVSVIQNLPKNGTPGTVWAR

SEQ ID NO: 1816 - protein, 268 aa, Homo sapiens; identical to SEQ ID NO: 1809
  Payload ID: 483;
  Gene Symbol: ACBD4;
  Gene Name: acyl-CoA binding domain containing 4;
  Uniprot ID:  Q8NC06;
  ENSP ID: ENSP00000482750

SEQ ID NO: 1817 - protein, 534 aa, Homo sapiens
  Payload ID: 484;
  Gene Symbol: ACBD5;
  Gene Name: acyl-CoA binding domain containing 5;
  Uniprot ID:  Q5T8D3;
  ENSP ID: ENSP00000365049
MFQFHAGSWESWCCCCLIPADRPWDRGQHWQLEMADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSVRLEKISKCLEDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 1818 - protein, 523 aa, Homo sapiens
  Payload ID: 484;
  Gene Symbol: ACBD5;
  Gene Name: acyl-CoA binding domain containing 5;
  ENSP ID: ENSP00000365062
MFQFHAGSWESWCCCCLIPADRPWDRGQHWQLEMADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 1819 - protein, 416 aa, Homo sapiens
  Payload ID: 484;
  Gene Symbol: ACBD5;
  Gene Name: acyl-CoA binding domain containing 5;
  Uniprot ID:  Q5T8D3;
  ENSP ID: ENSP00000365066
MTKEEAMIAYVEEMKKIIETMPMTEKVEELLRVIGPFYEIVEDKKSGRSSDITSDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 1820 - protein, 490 aa, Homo sapiens
  Payload ID: 484;
  Gene Symbol: ACBD5;
  Gene Name: acyl-CoA binding domain containing 5;
  Uniprot ID:  Q5T8D3;
  ENSP ID: ENSP00000365070
MADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 1821 - protein, 525 aa, Homo sapiens
  Payload ID: 484;
  Gene Symbol: ACBD5;
  Gene Name: acyl-CoA binding domain containing 5;
  Uniprot ID:  Q5T8D3;
  ENSP ID: ENSP00000379568
MLFLSFHAGSWESWCCCCLIPADRPWDRGQHWQLEMADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 1822 - protein, 251 aa, Homo sapiens
  Payload ID: 484;
  Gene Symbol: ACBD5;
  Gene Name: acyl-CoA binding domain containing 5;
  ENSP ID: ENSP00000393398
MADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSVRLEKISKCLEDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIH

SEQ ID NO: 1823 - protein, 252 aa, Homo sapiens
  Payload ID: 484;
  Gene Symbol: ACBD5;
  Gene Name: acyl-CoA binding domain containing 5;
  ENSP ID: ENSP00000401591
MADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSVRLEKISKCLEDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQ

SEQ ID NO: 1824 - protein, 67 aa, Homo sapiens
  Payload ID: 484;
  Gene Symbol: ACBD5;
  Gene Name: acyl-CoA binding domain containing 5;
  ENSP ID: ENSP00000483256
MFQFHAGSWESWCCCCLIPADRPWDRGQHWQLEMADTRSVHETRFEAAVKVIQSLPKNGMLGVHWVI

SEQ ID NO: 1825 - protein, 282 aa, Homo sapiens
  Payload ID: 485;
  Gene Symbol: ACBD6;
  Gene Name: acyl-CoA binding domain containing 6;
  Uniprot ID:  Q9BR61;
  ENSP ID: ENSP00000356567
MASSFLPAGAITGDSGGELSSGDDSGEVEFPHSPEIEETSCLAELFEKAAAHLQGLIQVASREQLLYLYARYKQVKVGNCNTPKPSFFDFEGKQKWEAWKALGDSSPSQAMQEYIAVVKKLDPGWNPQIPEKKGKEANTGFGGPVISSLYHEETIREEDKNIFDYCRENNIDHITKAIKSKNVDVNVKDEEGRALLHWACDRGHKELVTVLLQHRADINCQDNEGQTALHYASACEFLDIVELLLQSGADPTLRDQDGCLPEEVTGCKTVSLVLQRHTTGKA

SEQ ID NO: 1826 - protein, 88 aa, Homo sapiens
  Payload ID: 486;
  Gene Symbol: ACBD7;
  Gene Name: acyl-CoA binding domain containing 7;
  Uniprot ID:  Q8N6N7;
  ENSP ID: ENSP00000367453
MALQADFDRAAEDVRKLKARPDDGELKELYGLYKQAIVGDINIACPGMLDLKGKAKWEAWNLKKGLSTEDATSAYISKAKELIEKYGI

SEQ ID NO: 1827 - protein, 1059 aa, Homo sapiens
  Payload ID: 487;
  Gene Symbol: ACAD10;
  Gene Name: acyl-CoA dehydrogenase family, member 10;
  Uniprot ID:  Q6JQN1;
  ENSP ID: ENSP00000325137
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGGHGEVRFEHVRVPKENMVLGPGRGFEIAQGRLGPGRIHHCMRLIGFSERALALMKARVKSRLAFGKPLVEQGTVLADIAQSRVEIEQARLLVLRAAHLMDLAGNKAAALDIAMIKMVAPSMASRVIDRAIQAFGAAGLSSDYPLAQFFTWARALRFADGPDEVHRATVAKLELKHRI

SEQ ID NO: 1828 - protein, 1090 aa, Homo sapiens
  Payload ID: 487;
  Gene Symbol: ACAD10;
  Gene Name: acyl-CoA dehydrogenase family, member 10;
  Uniprot ID:  Q6JQN1;
  ENSP ID: ENSP00000389813
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKRQGFAVLPKLVSNSWAQAIYPPYPPKVVRLQVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGGHGEVRFEHVRVPKENMVLGPGRGFEIAQGRLGPGRIHHCMRLIGFSERALALMKARVKSRLAFGKPLVEQGTVLADIAQSRVEIEQARLLVLRAAHLMDLAGNKAAALDIAMIKMVAPSMASRVIDRAIQAFGAAGLSSDYPLAQFFTWARALRFADGPDEVHRATVAKLELKHRI

SEQ ID NO: 1829 - protein, 96 aa, Homo sapiens
  Payload ID: 487;
  Gene Symbol: ACAD10;
  Gene Name: acyl-CoA dehydrogenase family, member 10;
  ENSP ID: ENSP00000421527
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEI

SEQ ID NO: 1830 - protein, 278 aa, Homo sapiens
  Payload ID: 487;
  Gene Symbol: ACAD10;
  Gene Name: acyl-CoA dehydrogenase family, member 10;
  ENSP ID: ENSP00000446711
  MOD_RES (1)..(1): Any amino acid
XELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHF

SEQ ID NO: 1831 - protein, 710 aa, Homo sapiens
  Payload ID: 487;
  Gene Symbol: ACAD10;
  Gene Name: acyl-CoA dehydrogenase family, member 10;
  ENSP ID: ENSP00000446959
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKVKQPW

SEQ ID NO: 1832 - protein, 13 aa, Homo sapiens
  Payload ID: 487;
  Gene Symbol: ACAD10;
  Gene Name: acyl-CoA dehydrogenase family, member 10;
  ENSP ID: ENSP00000446998
MCVRSCFQSPRLQ

SEQ ID NO: 1833 - protein, 226 aa, Homo sapiens
  Payload ID: 487;
  Gene Symbol: ACAD10;
  Gene Name: acyl-CoA dehydrogenase family, member 10;
  ENSP ID: ENSP00000447561
VNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGSTTWCFIQKSQRCLLSLTGNFLPWATPLLMWPTAAWLITCH

SEQ ID NO: 1834 - protein, 146 aa, Homo sapiens
  Payload ID: 487;
  Gene Symbol: ACAD10;
  Gene Name: acyl-CoA dehydrogenase family, member 10;
  ENSP ID: ENSP00000449097
MPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEV

SEQ ID NO: 1835 - protein, 780 aa, Homo sapiens
  Payload ID: 488;
  Gene Symbol: ACAD11;
  Gene Name: acyl-CoA dehydrogenase family, member 11;
  Uniprot ID:  Q709F0;
  ENSP ID: ENSP00000264990
MKPGATGESDLAEVLPQHKFDSKSLEAYLNQHLSGFGAEREATLTIAQYRAGKSNPTFYLQKGFQTYVLRKKPPGSLLPKAHQIDREFKVQKALFSIGFPVPKPILYCSDTSVIGTEFYVMEHVQGRIFRDLTIPGLSPAERSAIYVATVETLAQLHSLNIQSLQLEGYGIGAGYCKRQVSTWTKQYQAAAHQDIPAMQQLSEWLMKNLPDNDNEENLIHGDFRLDNIVFHPKECRVIAVLDWELSTIGHPLSDLAHFSLFYFWPRTVPMINQGSYSENSGIPSMEELISIYCRCRGINSILPNWNFFLALSYFKMAGIAQGVYSRYLLGNNSSEDSFLFANIVQPLAETGLQLSKRTFSTVLPQIDTTGQLFVQTRKGQEVLIKVKHFMKQHILPAEKEVTEFYVQNENSVDKWGKPLVIDKLKEMAKVEGLWNLFLPAVSGLSHVDYALIAEETGKCFFAPDVFNCQAPDTGNMEVLHLYGSEEQKKQWLEPLLQGNITSCFCMTEPDVASSDATNIECSIQRDEDSYVINGKKWWSSGAGNPKCKIAIVLGRTQNTSLSRHKQHSMILVPMNTPGVKIIRPLSVFGYTDNFHGGHFEIHFNQVRVPATNLILGEGRGFEISQGRLGPGRIHHCMRTVGLAERALQIMCERATQRIAFKKKLYAHEVVAHWIAESRIAIEKIRLLTLKAAHSMDTLGSAGAKKEIAMIKVAAPRAVSKIVDWAIQVCGGAGVSQDYPLANMYAITRVLRLADGPDEVHLSAIATMELRDQAKRLTAKI

SEQ ID NO: 1836 - protein, 433 aa, Homo sapiens
  Payload ID: 488;
  Gene Symbol: ACAD11;
  Gene Name: acyl-CoA dehydrogenase family, member 11;
  ENSP ID: ENSP00000419973
MKPGATGESDLAEVLPQHKFDSKSLEAYLNQHLSGFGAEREATLTIAQYRAGKSNPTFYLQKGFQTYVLRKKPPGSLLPKAHQIDREFKVQKALFSIGFPVPKPILYCSDTSVIGTEFYVMEHVQGRIFRDLTIPGLSPAERSAIYVATVETLAQLHSLNIQSLQLEGYGIGAGYCKRQVSTWTKQYQAAAHQDIPAMQQLSEWLMKNLPDNDNEENLIHGDFRLDNIVFHPKECRVIAVLDWELSTIGHPLSDLAHFSLFYFWPRTVPMINQGSYSENSGIPSMEELISIYCRCRGINSILPNWNFFLALSYFKMAGIAQGVYSRYLLGNNSSEDSFLFANIVQPLAETGLQLSKRTFSTVLPQIDTTGQLFVQTRKGQEVLIKVKHFMKQHILPAEKTQGIWRFCTCMEVRNRRNSGLSLFFKGTLPLASV

SEQ ID NO: 1837 - protein, 476 aa, Homo sapiens
  Payload ID: 488;
  Gene Symbol: ACAD11;
  Gene Name: acyl-CoA dehydrogenase family, member 11;
  ENSP ID: ENSP00000420907
MKPGATGESDLAEVLPQHKFDSKSLEAYLNQHLSGFGAEREATLTIAQYRAGKSNPTFYLQKGFQTYVLRKKPPGSLLPKAHQIDREFKVQKALFSIGFPVPKPILYCSDTSVIGTEFYVMEHVQGRIFRDLTIPGLSPAERSAIYVATVETLAQLHSLNIQSLQLEGYGIGAGYCKRQVSTWTKQYQAAAHQDIPAMQQLSEWLMKNLPDNDNEENLIHGDFRLDNIVFHPKECRVIAVLDWELSTIGHPLSDLAHFSLFYFWPRTVPMINQGSYSENSGIPSMEELISIYCRCRGINSILPNWNFFLALSYFKMAGIAQGVYSRYLLGNNSSEDSFLFANIVQPLAETGLQLSKRTFSTVLPQIDTTGQLFVQTRKGQEVLIKVKHFMKQHILPAEKEVTEFYVQNENSVDKWGKPLVIDKLKEMAKVEGLWNLFLPAVSGLSHVDYALIAEETGKCFFAPDVFNCQAPGYYIN

SEQ ID NO: 1838 - protein, 155 aa, Homo sapiens
  Payload ID: 488;
  Gene Symbol: ACAD11;
  Gene Name: acyl-CoA dehydrogenase family, member 11;
  ENSP ID: ENSP00000423796
GLSHVDYALIAEETGKCFFAPDVFNCQAPDTGNMEVLHLYGSEEQKKQWLEPLLQGNITSCFCMTEPDVASSDATNIECSIQRDEDSYVINGKKWWSSGAGNPKCKIAIVLGRTQNTSLSRSQPASDYVGVRLLHSSHSSHHCLHDYMKTSKRQL

SEQ ID NO: 1839 - protein, 415 aa, Homo sapiens
  Payload ID: 489;
  Gene Symbol: ACAD8;
  Gene Name: acyl-CoA dehydrogenase family, member 8;
  Uniprot ID:  Q9UKU7;
  ENSP ID: ENSP00000281182
MLWSGCRRFGARLGCLPGGLRVLVQTGHRSLTSCIDPSMGLNEEQKEFQKVAFDFAAREMAPNMAEWDQKELFPVDVMRKAAQLGFGGVYIQTDVGGSGLSRLDTSVIFEALATGCTSTTAYISIHNMCAWMIDSFGNEEQRHKFCPPLCTMEKFASYCLTEPGSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEGSNEVMRILISRSLLQE

SEQ ID NO: 1840 - protein, 288 aa, Homo sapiens
  Payload ID: 489;
  Gene Symbol: ACAD8;
  Gene Name: acyl-CoA dehydrogenase family, member 8;
  Uniprot ID:  Q9UKU7;
  ENSP ID: ENSP00000363884
MLWSGCRRFGARLGCLPGGLRVLVQTGHRSLTSCIDRSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEGSNEVMRILISRSLLQE

SEQ ID NO: 1841 - protein, 76 aa, Homo sapiens
  Payload ID: 489;
  Gene Symbol: ACAD8;
  Gene Name: acyl-CoA dehydrogenase family, member 8;
  ENSP ID: ENSP00000431310
MLWSGCRRFGARLGCLPGGLRVLVQTGHRSLTSCIDPSMGLNEEQKEFQKVAFDFAAREMAPNMAEWDQKHVCLDD

SEQ ID NO: 1842 - protein, 69 aa, Homo sapiens
  Payload ID: 489;
  Gene Symbol: ACAD8;
  Gene Name: acyl-CoA dehydrogenase family, member 8;
  ENSP ID: ENSP00000431532
MLWSGCRRFGARLGCLPGGLRVLVQTGHRSLTSCIDRAVPSGCDAEGSPARLRRGLHTNRCGRVWAVTS

SEQ ID NO: 1843 - protein, 621 aa, Homo sapiens
  Payload ID: 490;
  Gene Symbol: ACAD9;
  Gene Name: acyl-CoA dehydrogenase family, member 9;
  Uniprot ID:  Q9H845;
  ENSP ID: ENSP00000312618
MSGCGLFLRTTAAARACRGLVVSTANRRLLRTSPPVRAFAKELFLGKIKKKEVFPFPEVSQDELNEINQFLGPVEKFFTEEVDSRKIDQEGKIPDETLEKLKSLGLFGLQVPEEYGGLGFSNTMYSRLGEIISMDGSITVTLAAHQAIGLKGIILAGTEEQKAKYLPKLASGEHIAAFCLTEPASGSDAASIRSRATLSEDKKHYILNGSKVWITNGGLANIFTVFAKTEVVDSDGSVKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 1844 - protein, 99 aa, Homo sapiens
  Payload ID: 490;
  Gene Symbol: ACAD9;
  Gene Name: acyl-CoA dehydrogenase family, member 9;
  ENSP ID: ENSP00000422020
MSGCGLFLRTTAAARACRGLVVSTANRRLLRTSPPVRAFAKELFLGKIKKKFSHFQKLAKMNLMKSISSWDPWKNSSLKRWTPEKLTRKGKSQMKLWRN

SEQ ID NO: 1845 - protein, 384 aa, Homo sapiens
  Payload ID: 490;
  Gene Symbol: ACAD9;
  Gene Name: acyl-CoA dehydrogenase family, member 9;
  ENSP ID: ENSP00000422683
VKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 1846 - protein, 173 aa, Homo sapiens
  Payload ID: 490;
  Gene Symbol: ACAD9;
  Gene Name: acyl-CoA dehydrogenase family, member 9;
  ENSP ID: ENSP00000423758
MSGCGLFLRTTAAARACRGLVVSTANRRLLRTSPPVRAFAKELFLGKIKKKEVFPFPEVSQDELNEINQFLGPVEKFFTEEAYICLIKIFLLAVDSRKIDQEGKIPDETLEKLKSLGLFGLQVPEEYGGLGFSNTMYSRLGEIISMDGSITVTLAAHQAIGLKGIILAGTEEQ

SEQ ID NO: 1847 - protein, 93 aa, Homo sapiens
  Payload ID: 490;
  Gene Symbol: ACAD9;
  Gene Name: acyl-CoA dehydrogenase family, member 9;
  ENSP ID: ENSP00000425226
MSGCGLFLRTTAAARACRGLVVSTANRRLLRTSPPVRAFAKELFLGKIKKVTRALGEPLLSGSRFSPSAARLVLNFVRFPKPAREIHPAAEAC

SEQ ID NO: 1848 - protein, 93 aa, Homo sapiens; identical to SEQ ID NO: 1847
  Payload ID: 490;
  Gene Symbol: ACAD9;
  Gene Name: acyl-CoA dehydrogenase family, member 9;
  ENSP ID: ENSP00000425346

SEQ ID NO: 1849 - protein, 93 aa, Homo sapiens; identical to SEQ ID NO: 1847
  Payload ID: 490;
  Gene Symbol: ACAD9;
  Gene Name: acyl-CoA dehydrogenase family, member 9;
  ENSP ID: ENSP00000426189

SEQ ID NO: 1850 - protein, 69 aa, Homo sapiens
  Payload ID: 490;
  Gene Symbol: ACAD9;
  Gene Name: acyl-CoA dehydrogenase family, member 9;
  ENSP ID: ENSP00000426277
MSGCGLFLRTTAAARACRGLVVSTANRRLLRTSPPVRAFAKELFLGKIKKWTPEKLTRKGKSQMKLWRN

SEQ ID NO: 1851 - protein, 93 aa, Homo sapiens
  Payload ID: 490;
  Gene Symbol: ACAD9;
  Gene Name: acyl-CoA dehydrogenase family, member 9;
  ENSP ID: ENSP00000427283
MSGCGLFLRTTAAARACRGLVVSTANRRLLRTSPPVRAFAKELFLGKIKKKLAKMNLMKSISSWDPWKNSSLKRWTPEKLTRKGKSQMKLWRN

SEQ ID NO: 1852 - protein, 168 aa, Homo sapiens
  Payload ID: 490;
  Gene Symbol: ACAD9;
  Gene Name: acyl-CoA dehydrogenase family, member 9;
  ENSP ID: ENSP00000478191
MEEQLVLKGGQHPHQPVWHDGRAVAGQPLHPHWAPQPRPRGSLGQHLLRGSLLAESLQPLSAGQVCSRKPRSRLRKCPSRSLRSEPISVPTLWTGHAERGQCPLLPPAPTHGPLLDDCYSFFRRLGLSQVKPFVPRLHLKGCRLAWESLFQVLTCRQCSLTGPSQLLN

SEQ ID NO: 1853 - protein, 412 aa, Homo sapiens
  Payload ID: 491;
  Gene Symbol: ACADS;
  Gene Name: acyl-CoA dehydrogenase, C-2 to C-3 short chain;
  Uniprot ID:  P16219;
  ENSP ID: ENSP00000242592
MAAALLARASGPARRALCPRAWRQLHTIYQSVELPETHQMLLQTCRDFAEKELFPIAAQVDKEHLFPAAQVKKMGGLGLLAMDVPEELGGAGLDYLAYAIAMEEISRGCASTGVIMSVNNSLYLGPILKFGSKEQKQAWVTPFTSGDKIGCFALSEPGNGSDAGAASTTARAEGDSWVLNGTKAWITNAWEASAAVVFASTDRALQNKGISAFLVPMPTPGLTLGKKEDKLGIRGSSTANLIFEDCRIPKDSILGEPGMGFKIAMQTLDMGRIGIASQALGIAQTALDCAVNYAENRMAFGAPLTKLQVIQFKLADMALALESARLLTWRAAMLKDNKKPFIKEAAMAKLAASEAATAISHQAIQILGGMGYVTEMPAERHYRDARITEIYEGTSEIQRLVIAGHLLRSYRS

SEQ ID NO: 1854 - protein, 408 aa, Homo sapiens
  Payload ID: 491;
  Gene Symbol: ACADS;
  Gene Name: acyl-CoA dehydrogenase, C-2 to C-3 short chain;
  ENSP ID: ENSP00000401045
MAAALLARASGPARRALCPRAWRQLHTIYQSVELPETHQMLLQTCRDFAEKELFPIAAQVDKEHLFPAAQVKKMGGLGLLAMDVPEELGGAGLDYLAYAIAMEEISRGCASTGVIMSVNNSLYLGPILKFGSKEQKQAWVTPFTSGDKIGCFALSEPGPSLLGPTGPIFALGQVGCPCPSSAATEACTFPRSRQRVSRPELLREGISAFLVPMPTPGLTLGKKEDKLGIRGSSTANLIFEDCRIPKDSILGEPGMGFKIAMQTLDMGRIGIASQALGIAQTALDCAVNYAENRMAFGAPLTKLQVIQFKLADMALALESARLLTWRAAMLKDNKKPFIKEAAMAKLAASEAATAISHQAIQILGGMGYVTEMPAERHYRDARITEIYEGTSEIQRLVIAGHLLRSYRS

SEQ ID NO: 1855 - protein, 454 aa, Homo sapiens
  Payload ID: 492;
  Gene Symbol: ACADM;
  Gene Name: acyl-CoA dehydrogenase, C-4 to C-12 straight chain;
  ENSP ID: ENSP00000359871
MAAGFGRCCRVLRSISRFHWRSQHTKANRQREPGLGFSFEFTEQQKEFQATARKFAREEIIPVAAEYDKTGEYPVPLIRRAWELGLMNTHIPENCDYSVCPLLEACTLYLDAFFLLLTGSNLNLHLNLGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 1856 - protein, 421 aa, Homo sapiens
  Payload ID: 492;
  Gene Symbol: ACADM;
  Gene Name: acyl-CoA dehydrogenase, C-4 to C-12 straight chain;
  Uniprot ID:  P11310;
  ENSP ID: ENSP00000359878
MAAGFGRCCRVLRSISRFHWRSQHTKANRQREPGLGFSFEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 1857 - protein, 425 aa, Homo sapiens
  Payload ID: 492;
  Gene Symbol: ACADM;
  Gene Name: acyl-CoA dehydrogenase, C-4 to C-12 straight chain;
  Uniprot ID:  P11310;
  ENSP ID: ENSP00000409612
MAAGFGRCCRCSLQVLRSISRFHWRSQHTKANRQREPGLGFSFEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 1858 - protein, 50 aa, Homo sapiens
  Payload ID: 492;
  Gene Symbol: ACADM;
  Gene Name: acyl-CoA dehydrogenase, C-4 to C-12 straight chain;
  ENSP ID: ENSP00000431372
MAAGFGRCCRVLRSISRFHWRSQHTKANRQREPGLGFSFGLLCNRTWSRL

SEQ ID NO: 1859 - protein, 47 aa, Homo sapiens
  Payload ID: 492;
  Gene Symbol: ACADM;
  Gene Name: acyl-CoA dehydrogenase, C-4 to C-12 straight chain;
  ENSP ID: ENSP00000431953
MAAGFGRCCRSSPNSRKNFKLLLVNLPERKSSQWLQNMIKLVNIQSP

SEQ ID NO: 1860 - protein, 45 aa, Homo sapiens
  Payload ID: 492;
  Gene Symbol: ACADM;
  Gene Name: acyl-CoA dehydrogenase, C-4 to C-12 straight chain;
  ENSP ID: ENSP00000432522
MAAGFGRCCRVLRSISRFHWRSQHTKANRQREPGLGFSFVSSPPN

SEQ ID NO: 1861 - protein, 76 aa, Homo sapiens
  Payload ID: 492;
  Gene Symbol: ACADM;
  Gene Name: acyl-CoA dehydrogenase, C-4 to C-12 straight chain;
  ENSP ID: ENSP00000434092
MAAGFGRCCRVLRSISRFHWRSQHTKANRQREPGLGFSFEFTEQQKEFQATARKFAREEIIPVAAEYDKTGEFFFF

SEQ ID NO: 1862 - protein, 67 aa, Homo sapiens
  Payload ID: 492;
  Gene Symbol: ACADM;
  Gene Name: acyl-CoA dehydrogenase, C-4 to C-12 straight chain;
  ENSP ID: ENSP00000434284
LIGDGAGFKVAMGAFDKTRPVVAAGAVGLAQRALDEATKYALERKTFGKLLVEVLFPLHLPTSLKVS

SEQ ID NO: 1863 - protein, 47 aa, Homo sapiens; identical to SEQ ID NO: 1859
  Payload ID: 492;
  Gene Symbol: ACADM;
  Gene Name: acyl-CoA dehydrogenase, C-4 to C-12 straight chain;
  ENSP ID: ENSP00000434823

SEQ ID NO: 1864 - protein, 104 aa, Homo sapiens
  Payload ID: 492;
  Gene Symbol: ACADM;
  Gene Name: acyl-CoA dehydrogenase, C-4 to C-12 straight chain;
  ENSP ID: ENSP00000435584
MAAGFGRCCRVLRSISRFHWRSQHTKANRQREPGLGFSFEFTEQQKEFQATARKFAREEIIPVAAEYDKTGEYPVPLIRRAWELGLMNTHIPENCANAYYYCWK

SEQ ID NO: 1865 - protein, 385 aa, Homo sapiens
  Payload ID: 492;
  Gene Symbol: ACADM;
  Gene Name: acyl-CoA dehydrogenase, C-4 to C-12 straight chain;
  ENSP ID: ENSP00000442324
MLQEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 1866 - protein, 430 aa, Homo sapiens [sequence omitted]

SEQ ID NO: 1867 - protein, 330 aa, Homo sapiens
  Payload ID: 494;
  Gene Symbol: ACADSB;
  Gene Name: acyl-CoA dehydrogenase, short/branched chain;
  Uniprot ID:  P45954;
  ENSP ID: ENSP00000357862
MGIEVDPEYGGTGASFLSTVLVIEELAKVDASVAVFCEIQNTLINTLIRKHGTEEQKATYLPQLTTEKVGSFCLSEAGAGSDSFALKTRADKEGDYYVLNGSKMWISSAEHAGLFLVMANVDPTIGYKGITSFLVDRDTPGLHIGKPENKLGLRASSTCPLTFENVKVPEANILGQIGHGYKYAIGSLNEGRIGIAAQMLGLAQGCFDYTIPYIKERIQFGKRLFDFQGLQHQVAHVATQLEAARLLTYNAARLLEAGKPFIKEASMAKYYASEIAGQTTSKCIEWMGGVGYTKDYPVEKYFRDAKIGTIYEGASNIQLNTIAKHIDAEY

SEQ ID NO: 1868 - protein, 432 aa, Homo sapiens
  Payload ID: 494;
  Gene Symbol: ACADSB;
  Gene Name: acyl-CoA dehydrogenase, short/branched chain;
  Uniprot ID:  P45954;
  ENSP ID: ENSP00000357873
MEGLAVRLLRGSRLLRRNFLTCLSSWKIPPHVSKSSQSEALLNITNNGIHFAPLQTFTDEEMMIKSSVKKFAQEQIAPLVSTMDENSKMEKSVIQGLFQQGLMGIEVDPEYGGTGASFLSTVLVIEELAKVDASVAVFCEIQNTLINTLIRKHGTEEQKATYLPQLTTEKVGSFCLSEAGAGSDSFALKTRADKEGDYYVLNGSKMWISSAEHAGLFLVMANVDPTIGYKGITSFLVDRDTPGLHIGKPENKLGLRASSTCPLTFENVKVPEANILGQIGHGYKYAIGSLNEGRIGIAAQMLGLAQGCFDYTIPYIKERIQFGKRLFDFQGLQHQVAHVATQLEAARLLTYNAARLLEAGKPFIKEASMAKYYASEIAGQTTSKCIEWMGGVGYTKDYPVEKYFRDAKIGTIYEGASNIQLNTIAKHIDAEY

SEQ ID NO: 1869 - protein, 39 aa, Homo sapiens
  Payload ID: 495;
  Gene Symbol: ACADVL;
  Gene Name: acyl-CoA dehydrogenase, very long chain;
  ENSP ID: ENSP00000325395
MQAARMAASLGRQLLRLGGGRSVCDKRDGGQRPWAPGRH

SEQ ID NO: 1870 - protein, 633 aa, Homo sapiens
  Payload ID: 495;
  Gene Symbol: ACADVL;
  Gene Name: acyl-CoA dehydrogenase, very long chain;
  Uniprot ID:  P49748;
  ENSP ID: ENSP00000344152
MQAARMAASLGRQLLRLGGGSSRLTALLGQPRPGPARRPYAGGAAQESKSFAVGMFKGQLTTDQVFPYPSVLNEEQTQFLKELVEPVSRFFEEVNDPAKNDALEMVEETTWQGLKELGAFGLQVPSELGGVGLCNTQYARLVEIVGMHDLGVGITLGAHQSIGFKGILLFGTKAQKEKYLPKLASGETVAAFCLTEPSSGSDAASIRTSAVPSPCGKYYTLNGSKLWISNGGLADIFTVFAKTPVTDPATGAVKEKITAFVVERGFGGITHGPPEKKMGIKASNTAEVFFDGVRVPSENVLGEVGSGFKVAMHILNNGRFGMAAALAGTMRGIIAKAVDHATNRTQFGEKIHNFGLIQEKLARMVMLQYVTESMAYMVSANMDQGATDFQIEAAISKIFGSEAAWKVTDECIQIMGGMGFMKEPGVERVLRDLRIFRIFEGTNDILRLFVALQGCMDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEKMLCDTWCIEAAARIREGMAALQSDPWQQELYRNFKSISKALVERGGVVTSNPLGF

SEQ ID NO: 1871 - protein, 655 aa, Homo sapiens
  Payload ID: 495;
  Gene Symbol: ACADVL;
  Gene Name: acyl-CoA dehydrogenase, very long chain;
  Uniprot ID:  P49748;
  ENSP ID: ENSP00000349297
MQAARMAASLGRQLLRLGGGSSRLTALLGQPRPGPARRPYAGGAAQLALDKSDSHPSDALTRKKPAKAESKSFAVGMFKGQLTTDQVFPYPSVLNEEQTQFLKELVEPVSRFFEEVNDPAKNDALEMVEETTWQGLKELGAFGLQVPSELGGVGLCNTQYARLVEIVGMHDLGVGITLGAHQSIGFKGILLFGTKAQKEKYLPKLASGETVAAFCLTEPSSGSDAASIRTSAVPSPCGKYYTLNGSKLWISNGGLADIFTVFAKTPVTDPATGAVKEKITAFVVERGFGGITHGPPEKKMGIKASNTAEVFFDGVRVPSENVLGEVGSGFKVAMHILNNGRFGMAAALAGTMRGIIAKAVDHATNRTQFGEKIHNFGLIQEKLARMVMLQYVTESMAYMVSANMDQGATDFQIEAAISKIFGSEAAWKVTDECIQIMGGMGFMKEPGVERVLRDLRIFRIFEGTNDILRLFVALQGCMDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEKMLCDTWCIEAAARIREGMAALQSDPWQQELYRNFKSISKALVERGGVVTSNPLGF

SEQ ID NO: 1872 - protein, 678 aa, Homo sapiens
  Payload ID: 495;
  Gene Symbol: ACADVL;
  Gene Name: acyl-CoA dehydrogenase, very long chain;
  Uniprot ID:  P49748;
  ENSP ID: ENSP00000438689
MLGGLAAAAGTRIMGKEIEAEAQRPLRQTWRPGQPPAMTAKTMSSRLTALLGQPRPGPARRPYAGGAAQLALDKSDSHPSDALTRKKPAKAESKSFAVGMFKGQLTTDQVFPYPSVLNEEQTQFLKELVEPVSRFFEEVNDPAKNDALEMVEETTWQGLKELGAFGLQVPSELGGVGLCNTQYARLVEIVGMHDLGVGITLGAHQSIGFKGILLFGTKAQKEKYLPKLASGETVAAFCLTEPSSGSDAASIRTSAVPSPCGKYYTLNGSKLWISNGGLADIFTVFAKTPVTDPATGAVKEKITAFVVERGFGGITHGPPEKKMGIKASNTAEVFFDGVRVPSENVLGEVGSGFKVAMHILNNGRFGMAAALAGTMRGIIAKAVDHATNRTQFGEKIHNFGLIQEKLARMVMLQYVTESMAYMVSANMDQGATDFQIEAAISKIFGSEAAWKVTDECIQIMGGMGFMKEPGVERVLRDLRIFRIFEGTNDILRLFVALQGCMDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEKMLCDTWCIEAAARIREGMAALQSDPWQQELYRNFKSISKALVERGGVVTSNPLGF

SEQ ID NO: 1873 - protein, 282 aa, Homo sapiens
  Payload ID: 495;
  Gene Symbol: ACADVL;
  Gene Name: acyl-CoA dehydrogenase, very long chain;
  ENSP ID: ENSP00000442082
  MOD_RES (1)..(1): Any amino acid
XKLARMVMLQYVTESMAYMVSANMDQGATDFQIEAAISKIFGSEAAWKVTDECIQIMGGMGFMKEPGVERVLRDLRIFRIFEGTNDILRLFVALQGCMDKGKELSGLGSALKNPFGNAGLLLGEAGKQLRRRAGLGSGLSLSGLVHPELSRSGELAVRALEQFATVVEAKLIKHKKGIVSEEAGRECLSRRGPGPGSQPAQIYFHLLLPARASRSLSEGHPTAQHEKMLCDTWCIEAAARIREGMAALQSDPWQQELYRNFKSISKALVERGGVVTSNPLGF

SEQ ID NO: 1874 - protein, 76 aa, Homo sapiens
  Payload ID: 495;
  Gene Symbol: ACADVL;
  Gene Name: acyl-CoA dehydrogenase, very long chain;
  ENSP ID: ENSP00000462366
  MOD_RES (1)..(1): Any amino acid
XLKELVEPVSRFFEEVNDPAKNDALEMVEETTWQGLKELGAFGLQVPSELGGVGLCNTQIPASPPVRPFGGDRGHA

SEQ ID NO: 1875 - protein, 204 aa, Homo sapiens
  Payload ID: 495;
  Gene Symbol: ACADVL;
  Gene Name: acyl-CoA dehydrogenase, very long chain;
  ENSP ID: ENSP00000462611
  MOD_RES (1)..(1): Any amino acid
XEVGSGFKVAMHILNNGRFGMAAALAGTMRGIIAKAVDHATNRTQFGEKIHNFGLIQEKLARMVMLQYVTESMAYMVSANMDQGATDFQIEAAISKIFGSEAAWKVTDECIQIMGGMGFMKEPGVERVLRDLRIFRIFEGTNDILRLFVALQGCMAGRAGQRPESQRTCPPGVESEWRAGSTGSGAVCHCGGGQADKTQEGDCQ

SEQ ID NO: 1876 - protein, 155 aa, Homo sapiens
  Payload ID: 495;
  Gene Symbol: ACADVL;
  Gene Name: acyl-CoA dehydrogenase, very long chain;
  ENSP ID: ENSP00000463246
MQAARMAASLGRQLLRLGGGSSRLTALLGQPRPGPARRPYAGGAAQLALDKSDSHPSDALTRKKPAKNDALEMVEETTWQGLKELGAFGLQVPSELGGVGLCNTQYARLVEIVGMHDLGVGITLGAHQSIGFKGILLFGTKAQKEKYLPKLASGE

SEQ ID NO: 1877 - protein, 194 aa, Homo sapiens
  Payload ID: 495;
  Gene Symbol: ACADVL;
  Gene Name: acyl-CoA dehydrogenase, very long chain;
  ENSP ID: ENSP00000464254
  MOD_RES (1)..(1): Any amino acid
XLQYVTESMAYMVSANMDQGATDFQIEAAISKIFGSEAAWKVTDECIQIMGGMGFMKEPGVERVLRDLRIFRIFEGTNDILRLFVALQGCMAGRAGQRPESQRTCPPGVESEWRAVRALEQFATVVEAKLIKHKKGIVNEQFLLQRLADGAIDLYAMVVVLSRASRSLSEGHPTAQHEKMLCDTWCIEAAARIR

SEQ ID NO: 1878 - protein, 157 aa, Homo sapiens
  Payload ID: 495;
  Gene Symbol: ACADVL;
  Gene Name: acyl-CoA dehydrogenase, very long chain;
  ENSP ID: ENSP00000465353
MQAARMAASLGRQLLRLGGGSSRLTALLGQPRPGPARRPYAGGAAQLALDKSDSHPSDALTRKKPAKAESKSFAVGMFKGQLTTDQVFPYPSVLNEEQTQFLKELVEPVSRFFEEPGCGILCLPQEVNDPAKNDALEMVEETTWQGLKELGAFGLQV

SEQ ID NO: 1879 - protein, 45 aa, Homo sapiens
  Payload ID: 495;
  Gene Symbol: ACADVL;
  Gene Name: acyl-CoA dehydrogenase, very long chain;
  ENSP ID: ENSP00000466487
ALEQFATVVEAKLIKHKKGIVTAGRRGHRPLCHGGGSLEGLKIPE

SEQ ID NO: 1880 - protein, 224 aa, Homo sapiens
  Payload ID: 495;
  Gene Symbol: ACADVL;
  Gene Name: acyl-CoA dehydrogenase, very long chain;
  ENSP ID: ENSP00000467920
MQAARMAASLGRQLLRLGGGSSRLTALLGQPRPGPARRPYAGGAAQLALDKSDSHPSDALTRKKPAKAESKSFAVGMFKGQLTTDQVFPYPSVLNEEQTQFLKELVEPVSRFFEEVNDPAKNDALEMVEETTWQGLKELGAFGLQVPSELGGVGLCNTQYARLVEIVGMHDLGVGITLGAHQSIGFKGILLFGTKAQKEKYLPKLASALSPTGETVAAFCLTEP

SEQ ID NO: 1881 - protein, 660 aa, Homo sapiens
  Payload ID: 496;
  Gene Symbol: ACOX1;
  Gene Name: acyl-CoA oxidase 1, palmitoyl;
  Uniprot ID:  Q15067;
  ENSP ID: ENSP00000293217
MNPDLRRERDSASFNPELLTHILDGSPEKTRRRREIENMILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 1882 - protein, 660 aa, Homo sapiens
  Payload ID: 496;
  Gene Symbol: ACOX1;
  Gene Name: acyl-CoA oxidase 1, palmitoyl;
  Uniprot ID:  Q15067;
  ENSP ID: ENSP00000301608
MNPDLRRERDSASFNPELLTHILDGSPEKTRRRREIENMILNDPDFQHEDLNFLTRSQRYEVAVRKSAIMVKKMREFGIADPDEIMWFKKLHLVNFVEPVGLNYSMFIPTLLNQGTTAQKEKWLLSSKGLQIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 1883 - protein, 223 aa, Homo sapiens
  Payload ID: 496;
  Gene Symbol: ACOX1;
  Gene Name: acyl-CoA oxidase 1, palmitoyl;
  ENSP ID: ENSP00000458325
MNPDLRRERDSASFNPELLTHILDGSPEKTRRRREIENMILNDPDFQHEDLNFLTRSQRYEVAVRKSAIMVKKMREFGIADPDEIMWFKKLHLVNFVEPVGLNYSMFIPTLLNQGTTAQKEKWLLSSKGLQIIGTYAQTEMGHVLCTEGGLSLWIFTWACSCPPCFTRQLRSSRSASSCPPGTWRSLALMPRQRWVMELTFEAWKPQPRMTLKPRSSFSTVLL

SEQ ID NO: 1884 - protein, 71 aa, Homo sapiens
  Payload ID: 496;
  Gene Symbol: ACOX1;
  Gene Name: acyl-CoA oxidase 1, palmitoyl;
  ENSP ID: ENSP00000459936
MNPDLRRERDSASFNPELLTHILDGSPEKTRRRREIGEGGGRDLPPFPRKAGDSLDAESGALWGLGPLAQR

SEQ ID NO: 1885 - protein, 108 aa, Homo sapiens
  Payload ID: 496;
  Gene Symbol: ACOX1;
  Gene Name: acyl-CoA oxidase 1, palmitoyl;
  ENSP ID: ENSP00000461486
  MOD_RES (1)..(1): Any amino acid
XNMILNDPDFQHEDLNFLTRSQRYEVAVRKSAIMVKKMREFGIADPDEIMWFKKLHLVNFVEPVGLNYSMFIPTLLNQGTTAQKEKWLLSSKGLQIIGTYAQTEMGHG

SEQ ID NO: 1886 - protein, 156 aa, Homo sapiens
  Payload ID: 496;
  Gene Symbol: ACOX1;
  Gene Name: acyl-CoA oxidase 1, palmitoyl;
  ENSP ID: ENSP00000466210
MNPDLRRERDSASFNPELLTHILDGSPEKTRRRREIENMILNDPDFQHEDLNFLTRSQRYEVAVRKSAIMVKKMREFGIADPDEIMWFKKLHLVNFVEPVGLNYSMFIPTLLNQGTTAQKEKWLLSSKGLQIIGTYAQTEMGHVGKTSNHAIVLAQ

SEQ ID NO: 1887 - protein, 132 aa, Homo sapiens
  Payload ID: 496;
  Gene Symbol: ACOX1;
  Gene Name: acyl-CoA oxidase 1, palmitoyl;
  ENSP ID: ENSP00000466921
  MOD_RES (1)..(1): Any amino acid
XHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 1888 - protein, 71 aa, Homo sapiens; identical to SEQ ID NO: 1884
  Payload ID: 496;
  Gene Symbol: ACOX1;
  Gene Name: acyl-CoA oxidase 1, palmitoyl;
  ENSP ID: ENSP00000468435

SEQ ID NO: 1889 - protein, 153 aa, Homo sapiens
  Payload ID: 496;
  Gene Symbol: ACOX1;
  Gene Name: acyl-CoA oxidase 1, palmitoyl;
  ENSP ID: ENSP00000468651
  MOD_RES (1)..(1): Any amino acid
XNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEGFGWRNKTLQMHDLGDPCESIIL

SEQ ID NO: 1890 - protein, 681 aa, Homo sapiens
  Payload ID: 497;
  Gene Symbol: ACOX2;
  Gene Name: acyl-CoA oxidase 2, branched chain;
  Uniprot ID:  Q99424;
  ENSP ID: ENSP00000307697
MGSPVHRVSLGDTWSRQMHPDIESERYMQSFDVERLTNILDGGAQNTALRRKVESIIHSYPEFSCKDNYFMTQNERYKAAMRRAFHIRLIARRLGWLEDGRELGYAYRALSGDVALNIHRVFVRALRSLGSEEQIAKWDPLCKNIQIIATYAQTELGHGTYLQGLETEATYDAATQEFVIHSPTLTATKWWPGDLGRSATHALVQAQLICSGARRGMHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 1891 - protein, 93 aa, Homo sapiens
  Payload ID: 497;
  Gene Symbol: ACOX2;
  Gene Name: acyl-CoA oxidase 2, branched chain;
  ENSP ID: ENSP00000417877
EALEKLENEPAIQQVLKRLCDLHAIHGILTNSGDFLHDAFLSGAQVDMARTAYLDLLRLIREIRCKAIQAKEMGKVDSVNLRIKEMEGCHPVN

SEQ ID NO: 1892 - protein, 107 aa, Homo sapiens
  Payload ID: 497;
  Gene Symbol: ACOX2;
  Gene Name: acyl-CoA oxidase 2, branched chain;
  ENSP ID: ENSP00000418515
GTYLQGLETEATYDAATQEFVIHSPTLTATKWWPGDLGRSATHALVQAQLICSGARRGMHAFIVPIRSLQDHTPLPGVLISISFKESSLGTSDPRWTLIKQTMASCS

SEQ ID NO: 1893 - protein, 667 aa, Homo sapiens
  Payload ID: 497;
  Gene Symbol: ACOX2;
  Gene Name: acyl-CoA oxidase 2, branched chain;
  ENSP ID: ENSP00000418562
MGSPVHRVSLGDTWSRQMHPDIESERYMQSFDVERLTNILDGGAQNTALRRKVESIIHSYPEFSCKDNYFMTQNERYKAAMRRAFHIRLIARRLGWLEDGRELGYAYRALSGDVALNIHRVFVRALRSLGSEEQIAKWDPLCKNIQIIATYAQTELGHGTYLQGLETEATYDAATQEFVIHSPTLTATKWWPGDLGRSATHALVQAQLICSGARRGMHAFIVPIRSLQDHTPLPGIIIGDIGPKMDFDQTDNGFLQLNHVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 1894 - protein, 13 aa, Homo sapiens
  Payload ID: 497;
  Gene Symbol: ACOX2;
  Gene Name: acyl-CoA oxidase 2, branched chain;
  ENSP ID: ENSP00000419133
  MOD_RES (1)..(1): Any amino acid
XAQNTALRRKVDP

SEQ ID NO: 1895 - protein, 171 aa, Homo sapiens
  Payload ID: 497;
  Gene Symbol: ACOX2;
  Gene Name: acyl-CoA oxidase 2, branched chain;
  ENSP ID: ENSP00000419927
MGSPVHRVSLGDTWSRQMHPDIESERYMQSFDVERLTNILDGGAQNTALRRKVESIIHSYPEFSCKDNYFMTQNERYKAAMRRAFHIRLIARRLGWLEDGRELGYAYRALSGDVALNIHRVFVRALRSLGSEEQIAKWDPLCKNIQIIATYAQTELGHGTYLQGLETEATY

SEQ ID NO: 1896 - protein, 700 aa, Homo sapiens
  Payload ID: 498;
  Gene Symbol: ACOX3;
  Gene Name: acyl-CoA oxidase 3, pristanoyl;
  Uniprot ID:  O15254;
  ENSP ID: ENSP00000348775
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRGGYFSGEQAGEVLESAVLALCSQLKDDAVALVDVIAPPDFVLDSPIGRADGELYKNLWGAVLQESKVLERASWWPEFSVNKPVIGSLKSKL

SEQ ID NO: 1897 - protein, 624 aa, Homo sapiens
  Payload ID: 498;
  Gene Symbol: ACOX3;
  Gene Name: acyl-CoA oxidase 3, pristanoyl;
  Uniprot ID:  O15254;
  ENSP ID: ENSP00000413994
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRAERRCSCPGRRDRSS

SEQ ID NO: 1898 - protein, 700 aa, Homo sapiens; identical to SEQ ID NO: 1896
  Payload ID: 498;
  Gene Symbol: ACOX3;
  Gene Name: acyl-CoA oxidase 3, pristanoyl;
  Uniprot ID:  O15254;
  ENSP ID: ENSP00000421625

SEQ ID NO: 1899 - protein, 110 aa, Homo sapiens
  Payload ID: 498;
  Gene Symbol: ACOX3;
  Gene Name: acyl-CoA oxidase 3, pristanoyl;
  ENSP ID: ENSP00000427321
MFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTAT

SEQ ID NO: 1900 - protein, 279 aa, Homo sapiens
  Payload ID: 499;
  Gene Symbol: ACOXL;
  Gene Name: acyl-CoA oxidase-like;
  Uniprot ID:  Q9NUZ1;
  ENSP ID: ENSP00000343717
MRALTVQRVKFAMDLPLLKRAGQDLAEKTKNFVSRSLVIGEVLSMADMATGVKCGIIYWLFGGAIRNLGSPEHVTKWFQPLQEQKYTGMFAMTERGHGSNARGIQTEATFDLSAQEFVIDTPCENAEKMYIGNAMYGNYAAVFAQLIIDGRSQGPHCFIVPVRDENGSLYPGVTAIDMMYKEGLHGVDNGILIFDKVRIPRENLLDKFGSVAPDGQYHSPIRNKSARFNAMLAALTPSRLAVAFQAMGAMKLGLTIAIRYSHRSRIISQNCCSAPAGLY

SEQ ID NO: 1901 - protein, 547 aa, Homo sapiens
  Payload ID: 499;
  Gene Symbol: ACOXL;
  Gene Name: acyl-CoA oxidase-like;
  Uniprot ID:  Q9NUZ1;
  ENSP ID: ENSP00000374461
MRALTVQRVKFAMDLPLLKRAGQDLAEKTKNFVSRSLVIGEVLSMADMATGVKCGIIYWLFGGAIRNLGSPEHVTKWFQPLQEQKYTGMFAMTERGHGSNARGIQTEATFDLSAQEFVIDTPCENAEKMYIGNAMYGNYAAVFAQLIIDGRSQGPHCFIVPVRDENGSLYPGVTAIDMMYKEGLHGVDNGILIFDKVRIPRENLLDKFGSVAPDGQYHSPIRNKSARFNAMLAALTPSRLAVAFQAMGAMKLGLTIAIRYSHSRRQFGPKTKEEVKIIEHQTQTLRLMPHLATALALTFVSRYAGALLDEDVFQGKELVNSRSLQALVAGLKAYSTWENIRCLQDCRECTGGMGYMMENRISGLKCDTDVFATFEGDDVVMLQVVGRELLAQYTKQYEEKPLFGLLQNWAESVGDKLRTSFLAFNMDTVDDLAFLLKAVKFRERVLQRGLVARIYYKVKTKKEDFFHAWNSCLHHVASLSLAHTHRVTLEQFSLAVKSCPDQEDQTLLMKFCLLYGTKLVFQERAWYLEHKYLTPMASTRIRNQERC

SEQ ID NO: 1902 - protein, 355 aa, Homo sapiens
  Payload ID: 499;
  Gene Symbol: ACOXL;
  Gene Name: acyl-CoA oxidase-like;
  ENSP ID: ENSP00000387832
RDENGSLYPGVTAIDMMYKEGLHGVDNGILIFDKVRIPRENLLDKFGSVAPDGQYHSPIRNKSARFNAMLAALTPSRLAVAFQAMGAMKLGLTIAIRYSHSRRQFGPKTKEEVKIIEHQTQTLRLMPHLATALALTFVSRYAGALLDEDVFQGKELVNSRSLQALVAGLKAYSTWENIRCLQDCRECTGGMVVGRELLAQYTKQYEEKPLFGLLQNWAESVGDKLRTSFLAFNMDTVDDLAFLLKAVKFRERVLQRGLVARIYYKVKTKKEDFFHAWNSCLHHVASLSLAHTHRVTLEQFSLAVKSCPDQEDQTLLMKFCLLYGTKLVFQERAWYLEHKYLTPMASTRIRNQERC

SEQ ID NO: 1903 - protein, 93 aa, Homo sapiens
  Payload ID: 499;
  Gene Symbol: ACOXL;
  Gene Name: acyl-CoA oxidase-like;
  ENSP ID: ENSP00000393823
GDKLRTSFLAFNMDTVDDLAFLLKAVKFRERVLQRGLVARIYYKVKTKKEDFFHAWNSCLHHVASLSLAHTHRVLSVVWNQAGVSGAGLVFRT

SEQ ID NO: 1904 - protein, 70 aa, Homo sapiens
  Payload ID: 499;
  Gene Symbol: ACOXL;
  Gene Name: acyl-CoA oxidase-like;
  ENSP ID: ENSP00000394701
MRALTVQRVKFAMDLPLLKRAGQDLAEKTKNFVSRSLVIGEVLSMADMATGVKCGIIYWLFGGAIRNLGS

SEQ ID NO: 1905 - protein, 161 aa, Homo sapiens
  Payload ID: 499;
  Gene Symbol: ACOXL;
  Gene Name: acyl-CoA oxidase-like;
  ENSP ID: ENSP00000406774
  MOD_RES (1)..(1): Any amino acid
XRFNAMLAALTPSRLAVAFQAMGAMKLGLTIAIRYSHRYAGALLDEDVFQGKELVNSRSLQALVAGLKAYSTWENIRCLQDCRECTGGMGYMMENRISGLKCDTDVFATFEGDDVVMLQVVGRELLAQYTKQYEEKPLFGLLQNWAESVGDKLRTSFLAFN

SEQ ID NO: 1906 - protein, 580 aa, Homo sapiens
  Payload ID: 499;
  Gene Symbol: ACOXL;
  Gene Name: acyl-CoA oxidase-like;
  Uniprot ID:  Q9NUZ1;
  ENSP ID: ENSP00000407761
MRALTVQRVKFAMDLPLLKRAGQDLAEKTKNFVSRSLVIGEVLSMADMATGVKCGIIYWLFGGAIRNLGSPEHVTKWFQPLQEQKYTGMFAMTERGHGSNARGIQTEATFDLSAQEFVIDTPCENAEKMYIGNAMYGNYAAVFAQLIIDGRSQGPHCFIVPVRDENGSLYPGVTAIDMMYKEGLHGVDNGILIFDKVRIPRENLLDKFGSVAPDGQYHSPIRNKSARFNAMLAALTPSRLAVAFQAMGAMKLGLTIAIRYSHSRRQFGPKTKEEVKIIEHQTQTLRLMPHLATALALTFVSRYAGALLDEDVFQGKELVNSRSLQALVAGLKAYSTWENIRCLQDCRECTGGMVVGRELLAQYTKQYEEKPLFGLLQNWAESVGDKLRTSFLAFNMDTVDDLAFLLKAVKFRERVLQRGLVARIYYKVKTKKEDFFHAWNSCLHHVASLSLAHTHRVTLEQFSLAVKSCPDQEDQTLLMKFCLLYGTKLVFQERAWYLEHKYLTPMASTRIRNQLLDLCDSVKDDARRVISTFNIPHTYLHAPIAGISNPRAAWAFYPAPLQPRPREEARSRRPKLGAKL

SEQ ID NO: 1907 - protein, 106 aa, Homo sapiens
  Payload ID: 499;
  Gene Symbol: ACOXL;
  Gene Name: acyl-CoA oxidase-like;
  ENSP ID: ENSP00000409500
GYMMENRISGLKCDTDVFATFEGDDVVMLQVVGRELLAQYTKQYEEKPLFGLLQNWAESVGDKLRTSFLAFNMDTVDDLAFLLKAVKFRERVLQRGLVARIYYKLP

SEQ ID NO: 1908 - protein, 724 aa, Homo sapiens
  Payload ID: 500;
  Gene Symbol: ACSBG1;
  Gene Name: acyl-CoA synthetase bubblegum family member 1;
  Uniprot ID:  Q96GR2;
  ENSP ID: ENSP00000258873
MPRNSGAGYGCPHGDPSMLDSRETPQESRQDMIVRTTQEKLKTSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIYKEPPPNKMANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 1909 - protein, 80 aa, Homo sapiens
  Payload ID: 500;
  Gene Symbol: ACSBG1;
  Gene Name: acyl-CoA synthetase bubblegum family member 1;
  ENSP ID: ENSP00000453447
MPRNSGAGYGCPHGDPSMLDSRETPQESRQDMIVRTTQEKLKTRGGAVDDSGRWAGAPAHRPQLPTASLHCASDVLRGPG

SEQ ID NO: 1910 - protein, 482 aa, Homo sapiens
  Payload ID: 500;
  Gene Symbol: ACSBG1;
  Gene Name: acyl-CoA synthetase bubblegum family member 1;
  ENSP ID: ENSP00000453451
MANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 1911 - protein, 243 aa, Homo sapiens
  Payload ID: 500;
  Gene Symbol: ACSBG1;
  Gene Name: acyl-CoA synthetase bubblegum family member 1;
  ENSP ID: ENSP00000453547
MPEVLLLRSASSILRTAFLSRWLPGGPRCVHKLSFVRNLQCRQGVRLNVRSSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIY

SEQ ID NO: 1912 - protein, 55 aa, Homo sapiens
  Payload ID: 500;
  Gene Symbol: ACSBG1;
  Gene Name: acyl-CoA synthetase bubblegum family member 1;
  ENSP ID: ENSP00000453585
MPRNSGAGYGCPHGDPSMLDSRETPQESRQDMIVRTTQEKLKTRDGVLLHCPGWP

SEQ ID NO: 1913 - protein, 51 aa, Homo sapiens
  Payload ID: 500;
  Gene Symbol: ACSBG1;
  Gene Name: acyl-CoA synthetase bubblegum family member 1;
  ENSP ID: ENSP00000453605
MPRNSGAGYGCPHGDPSMLDSRETPQESRQDMIVRTTQEKLKTRSGNSCHI

SEQ ID NO: 1914 - protein, 181 aa, Homo sapiens
  Payload ID: 500;
  Gene Symbol: ACSBG1;
  Gene Name: acyl-CoA synthetase bubblegum family member 1;
  ENSP ID: ENSP00000453800
MPRNSGAGYGCPHGDPSMLDSRETPQESRQDMIVRTTQEKLKTSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKQAHSVAILGFNSPEWFFSAVGTVFAGGIVT

SEQ ID NO: 1915 - protein, 138 aa, Homo sapiens
  Payload ID: 500;
  Gene Symbol: ACSBG1;
  Gene Name: acyl-CoA synthetase bubblegum family member 1;
  ENSP ID: ENSP00000454188
MFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIYKEPPPNKMAN

SEQ ID NO: 1916 - protein, 616 aa, Homo sapiens
  Payload ID: 501;
  Gene Symbol: ACSBG2;
  Gene Name: acyl-CoA synthetase bubblegum family member 2;
  Uniprot ID:  Q5FVE4;
  ENSP ID: ENSP00000464938
MTIPEFFRESVNRFGTYPALASKNGKKWEILNFNQYYEACRKAAKSLIKLGLERFHGVGILGFNSAEWFITAVGAILAGGLCVGIYATNSAEVCQYVITHAKVNILLVENDQQLQKILSIPQSSLEPLKAIIQYRLPMKKNNNLYSWDDFMELGRSIPDTQLEQVIESQKANQCAVLIYTSGTTGIPKGVMLSHDNITWIAGAVTKDFKLTDKHETVVSYLPLSHIAAQMMDIWVPIKIGALTYFAQADALKGTLVSTLKEVKPTVFIGVPQIWEKIHEMVKKNSAKSMGLKKKAFVWARNIGFKVNSKKMLGKYNTPVSYRMAKTLVFSKVKTSLGLDHCHSFISGTAPLNQETAEFFLSLDIPIGELYGLSESSGPHTISNQNNYRLLSCGKILTGCKNMLFQQNKDGIGEICLWGRHIFMGYLESETETTEAIDDEGWLHSGDLGQLDGLGFLYVTGHIKEILITAGGENVPPIPVETLVKKKIPIISNAMLVGDKLKFLSMLLTLKCEMNQMSGEPLDKLNFEAINFCRGLGSQASTVTEIVKQQDPLVYKAIQQGINAVNQEAMNNAQRIEKWVILEKDFSIYGGELGPMMKLKRHFVAQKYKKQIDHMYH

SEQ ID NO: 1917 - protein, 134 aa, Homo sapiens
  Payload ID: 501;
  Gene Symbol: ACSBG2;
  Gene Name: acyl-CoA synthetase bubblegum family member 2;
  ENSP ID: ENSP00000465088
MTGTPKTQEGAKDLEVDMNKTEVTPRLWTTCRDGEVLLRLSKHGPGHETPMTIPEFFRESVNRFGTYPALASKNGKKWEILNFNQYYEACRKAAKSLIKLGLERFHGVGILGFNSAEWFITAVGAILAGFHRAA

SEQ ID NO: 1918 - protein, 117 aa, Homo sapiens
  Payload ID: 501;
  Gene Symbol: ACSBG2;
  Gene Name: acyl-CoA synthetase bubblegum family member 2;
  ENSP ID: ENSP00000465581
YATNSAEVCQYVITHAKVNILLVENDQQLQKILSIPQSSLEPLKAIIQYRLPMKKNNNLYSWDDFMELGRSIPDTQLEQVIESQKANQCAVLIYTSGTTGIPKGVMLSHDNKNSLST

SEQ ID NO: 1919 - protein, 666 aa, Homo sapiens
  Payload ID: 501;
  Gene Symbol: ACSBG2;
  Gene Name: acyl-CoA synthetase bubblegum family member 2;
  Uniprot ID:  Q5FVE4;
  ENSP ID: ENSP00000465589
MTGTPKTQEGAKDLEVDMNKTEVTPRLWTTCRDGEVLLRLSKHGPGHETPMTIPEFFRESVNRFGTYPALASKNGKKWEILNFNQYYEACRKAAKSLIKLGLERFHGVGILGFNSAEWFITAVGAILAGGLCVGIYATNSAEVCQYVITHAKVNILLVENDQQLQKILSIPQSSLEPLKAIIQYRLPMKKNNNLYSWDDFMELGRSIPDTQLEQVIESQKANQCAVLIYTSGTTGIPKGVMLSHDNITWIAGAVTKDFKLTDKHETVVSYLPLSHIAAQMMDIWVPIKIGALTYFAQADALKGTLVSTLKEVKPTVFIGVPQIWEKIHEMVKKNSAKSMGLKKKAFVWARNIGFKVNSKKMLGKYNTPVSYRMAKTLVFSKVKTSLGLDHCHSFISGTAPLNQETAEFFLSLDIPIGELYGLSESSGPHTISNQNNYRLLSCGKILTGCKNMLFQQNKDGIGEICLWGRHIFMGYLESETETTEAIDDEGWLHSGDLGQLDGLGFLYVTGHIKEILITAGGENVPPIPVETLVKKKIPIISNAMLVGDKLKFLSMLLTLKCEMNQMSGEPLDKLNFEAINFCRGLGSQASTVTEIVKQQDPLVYKAIQQGINAVNQEAMNNAQRIEKWVILEKDFSIYGGELGPMMKLKRHFVAQKYKKQIDHMYH

SEQ ID NO: 1920 - protein, 142 aa, Homo sapiens
  Payload ID: 501;
  Gene Symbol: ACSBG2;
  Gene Name: acyl-CoA synthetase bubblegum family member 2;
  ENSP ID: ENSP00000465870
MTGTPKTQEGAKDLEVDMNKTEVTPRLWTTCRDGEVLLRLSKHGPGHETPMTIPEFFRESVNRFGTYPALASKNGKKWEILNFNQYYEACRKAAKSLIKLGLERFHGVGILGFNSAEWFITAVGAILAGGLCVGIYATNSAE

SEQ ID NO: 1921 - protein, 479 aa, Homo sapiens
  Payload ID: 501;
  Gene Symbol: ACSBG2;
  Gene Name: acyl-CoA synthetase bubblegum family member 2;
  Uniprot ID:  Q5FVE4;
  ENSP ID: ENSP00000466336
MKKNNNLYSWDDFMELGRSIPDTQLEQVIESQKANQCAVLIYTSGTTGIPKGVMLSHDNITWIAGAVTKDFKLTDKHETVVSYLPLSHIAAQMMDIWVPIKIGALTYFAQADALKGTLVSTLKEVKPTVFIGVPQIWEKIHEMVKKNSAKSMGLKKKAFVWARNIGFKVNSKKMLGKYNTPVSYRMAKTLVFSKVKTSLGLDHCHSFISGTAPLNQETAEFFLSLDIPIGELYGLSESSGPHTISNQNNYRLLSCGKILTGCKNMLFQQNKDGIGEICLWGRHIFMGYLESETETTEAIDDEGWLHSGDLGQLDGLGFLYVTGHIKEILITAGGENVPPIPVETLVKKKIPIISNAMLVGDKLKFLSMLLTLKCEMNQMSGEPLDKLNFEAINFCRGLGSQASTVTEIVKQQDPLVYKAIQQGINAVNQEAMNNAQRIEKWVILEKDFSIYGGELGPMMKLKRHFVAQKYKKQIDHMYH

SEQ ID NO: 1922 - protein, 37 aa, Homo sapiens
  Payload ID: 501;
  Gene Symbol: ACSBG2;
  Gene Name: acyl-CoA synthetase bubblegum family member 2;
  ENSP ID: ENSP00000466434
  MOD_RES (1)..(1): Any amino acid
XTLVKKKIPIISNAMLVGDKLKFLSMLLTLKPGIHRD

SEQ ID NO: 1923 - protein, 666 aa, Homo sapiens; identical to SEQ ID NO: 1919
  Payload ID: 501;
  Gene Symbol: ACSBG2;
  Gene Name: acyl-CoA synthetase bubblegum family member 2;
  Uniprot ID:  Q5FVE4;
  ENSP ID: ENSP00000467755

SEQ ID NO: 1924 - protein, 129 aa, Homo sapiens
  Payload ID: 501;
  Gene Symbol: ACSBG2;
  Gene Name: acyl-CoA synthetase bubblegum family member 2;
  ENSP ID: ENSP00000468394
MTGTPKTQEGAKDLEVDMNKTEVTPRLWTTCRDGEVLLRLSKHGPGHETPMTIPEFFRESVNRFGTYPALASKNGKKWEILNFNQYYEACRKAAKSLIKLGLERFHGVGILGFNSAEWFITAVGAILAG

SEQ ID NO: 1925 - protein, 76 aa, Homo sapiens
  Payload ID: 501;
  Gene Symbol: ACSBG2;
  Gene Name: acyl-CoA synthetase bubblegum family member 2;
  ENSP ID: ENSP00000468652
MTGTPKTQEGAKDLEVDMNKTEVTPRLWTTCRDGEVLLRLSKHGPGHETPMTIPEFFRESVNRFGTYPALASKNGK

SEQ ID NO: 1926 - protein, 134 aa, Homo sapiens; identical to SEQ ID NO: 1917
  Payload ID: 501;
  Gene Symbol: ACSBG2;
  Gene Name: acyl-CoA synthetase bubblegum family member 2;
  ENSP ID: ENSP00000468684

SEQ ID NO: 1927 - protein, 615 aa, Homo sapiens
  Payload ID: 502;
  Gene Symbol: ACSF2;
  Gene Name: acyl-CoA synthetase family member 2;
  Uniprot ID:  Q96CM8;
  ENSP ID: ENSP00000300441
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAGIILVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 1928 - protein, 640 aa, Homo sapiens
  Payload ID: 502;
  Gene Symbol: ACSF2;
  Gene Name: acyl-CoA synthetase family member 2;
  Uniprot ID:  Q96CM8;
  ENSP ID: ENSP00000401831
MAVYVGMLRLGRLCAGSSGVLGARAALSRSWQEARLQGVRFLSARGGMEAGRQRISVPSSFTASAAAHSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAGIILVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 1929 - protein, 104 aa, Homo sapiens
  Payload ID: 502;
  Gene Symbol: ACSF2;
  Gene Name: acyl-CoA synthetase family member 2;
  ENSP ID: ENSP00000421558
  MOD_RES (1)..(1): Any amino acid
XGKKALEAISRERGTFLYGTPTMFVDILNQPDFSSYDISTMCGGVIAGSPAPPELIRAIINKINMKDLVKSQEEIAAWEDGQQSTDVLLERPGRLLMEPQRTVP

SEQ ID NO: 1930 - protein, 602 aa, Homo sapiens
  Payload ID: 502;
  Gene Symbol: ACSF2;
  Gene Name: acyl-CoA synthetase family member 2;
  Uniprot ID:  Q96CM8;
  ENSP ID: ENSP00000421884
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 1931 - protein, 85 aa, Homo sapiens
  Payload ID: 502;
  Gene Symbol: ACSF2;
  Gene Name: acyl-CoA synthetase family member 2;
  ENSP ID: ENSP00000422546
TVPPSSWPLPSSMARRHWRPSAERGVIAGSPAPPELIRAIINKINMKDLVKSQEEIAAWEDGQQSTDVLLERPGRLLMEPQRTVP

SEQ ID NO: 1932 - protein, 183 aa, Homo sapiens
  Payload ID: 502;
  Gene Symbol: ACSF2;
  Gene Name: acyl-CoA synthetase family member 2;
  ENSP ID: ENSP00000424842
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGVCEPSLPGYGTGVCPQEGGLQGPCVPQAIQDPAILQRPEADLSRSGECPARGLEESEAP

SEQ ID NO: 1933 - protein, 45 aa, Homo sapiens
  Payload ID: 502;
  Gene Symbol: ACSF2;
  Gene Name: acyl-CoA synthetase family member 2;
  ENSP ID: ENSP00000425332
MAVYVGMLRLGRLCAGSSGVLGARAALSRSWQEARLQGVRFLRCL

SEQ ID NO: 1934 - protein, 572 aa, Homo sapiens
  Payload ID: 502;
  Gene Symbol: ACSF2;
  Gene Name: acyl-CoA synthetase family member 2;
  ENSP ID: ENSP00000425964
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 1935 - protein, 54 aa, Homo sapiens
  Payload ID: 502;
  Gene Symbol: ACSF2;
  Gene Name: acyl-CoA synthetase family member 2;
  ENSP ID: ENSP00000426730
MAVYVGMLRLGRLCAGSSGVLGARAALSRSWQEARLQGVRFLRPSGEKLAHQGV

SEQ ID NO: 1936 - protein, 576 aa, Homo sapiens
  Payload ID: 503;
  Gene Symbol: ACSF3;
  Gene Name: acyl-CoA synthetase family member 3;
  Uniprot ID:  Q4G176;
  ENSP ID: ENSP00000320646
MLPHVVLTFRRLGCALASCRLAPARHRGSGLLHTAPVARSDRSAPVFTRALAFGDRIALVDQHGRHTYRELYSRSLRLSQEICRLCGCVGGDLREERVSFLCANDASYVVAQWASWMSGGVAVPLYRKHPAAQLEYVICDSQSSVVLASQEYLELLSPVVRKLGVPLLPLTPAIYTGAVEEPAEVPVPEQGWRNKGAMIIYTSGTTGRPKGVLSTHQNIRAVVTGLVHKWAWTKDDVILHVLPLHHVHGVVNALLCPLWVGATCVMMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTTAVRLPGSVGTPLPGVQVRIVSENPQREACSYTIHAEGDERGTKVTPGFEEKEGELLVRGPSVFREYWNKPEETKSAFTLDGWFKTGDTVVFKDGQYWIRGRTSVDIIKTGGYKVSALEVEWHLLAHPSITDVAVIGVPDMTWGQRVTAVVTLREGHSLSHRELKEWARNVLAPYAVPSELVLVEEIPRNQMGKIDKKALIRHFHPS

SEQ ID NO: 1937 - protein, 311 aa, Homo sapiens
  Payload ID: 503;
  Gene Symbol: ACSF3;
  Gene Name: acyl-CoA synthetase family member 3;
  ENSP ID: ENSP00000367596
MMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTTAVRLPGSVGTPLPGVQVRIVSENPQREACSYTIHAEGDERGTKVTPGFEEKEGELLVRGPSVFREYWNKPEETKSAFTLDGWFKTGDTVVFKDGQYWIRGRTSVDIIKTGGYKVSALEVEWHLLAHPSITDVAVIGVPDMTWGQRVTAVVTLREGHSLSHRELKEWARNVLAPYAVPSELVLVEEIPRNQMGKIDKKALIRHFHPS

SEQ ID NO: 1938 - protein, 576 aa, Homo sapiens; identical to SEQ ID NO: 1936
  Payload ID: 503;
  Gene Symbol: ACSF3;
  Gene Name: acyl-CoA synthetase family member 3;
  Uniprot ID:  Q4G176;
  ENSP ID: ENSP00000384627

SEQ ID NO: 1939 - protein, 105 aa, Homo sapiens
  Payload ID: 503;
  Gene Symbol: ACSF3;
  Gene Name: acyl-CoA synthetase family member 3;
  ENSP ID: ENSP00000439201
MMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTT

SEQ ID NO: 1940 - protein, 237 aa, Homo sapiens
  Payload ID: 503;
  Gene Symbol: ACSF3;
  Gene Name: acyl-CoA synthetase family member 3;
  ENSP ID: ENSP00000440734
MLPHVVLTFRRLGCALASCRLAPARHRGSGLLHTAPVARSDRSAPVFTRALAFGDRIALVDQHGRHTYRELYSRSLRLSQEICRLCGCVGGDLREERVSFLCANDASYVVAQWASWMSGGVAVPLYRKHPAAQLEYVICDSQSSVVLASQEYLELLSPVVRKLGVPLLPLTPAIYTGAVEEPAEVPVPEQGWRNKGAMIIYTSGTTGRPKGVLSTHQNIRAVVTGLVHKWAWTKDDV

SEQ ID NO: 1941 - protein, 183 aa, Homo sapiens
  Payload ID: 503;
  Gene Symbol: ACSF3;
  Gene Name: acyl-CoA synthetase family member 3;
  ENSP ID: ENSP00000442683
  MOD_RES (1)..(1): Any amino acid
XLLCPLWVGATCVMMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTTAVRLPGSVGTPLPGVQVRIVSENPQREACSYTIHAEGDERGTKGPSPCCCPDMPLLGFLPLPCWY

SEQ ID NO: 1942 - protein, 235 aa, Homo sapiens
  Payload ID: 503;
  Gene Symbol: ACSF3;
  Gene Name: acyl-CoA synthetase family member 3;
  ENSP ID: ENSP00000442781
MMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTTAVRLPGSVGTPLPGVQVRIVSENPQREACSYTIHAEGDERGTKVTPGFEEKEGELLVRGPSVFREYWNKPEETKSAFTLDGWFKTGDTVVFKDGQYWIRGRTSVDIIKTGGYKVSALEVEWHLLAHPSIT

SEQ ID NO: 1943 - protein, 106 aa, Homo sapiens
  Payload ID: 503;
  Gene Symbol: ACSF3;
  Gene Name: acyl-CoA synthetase family member 3;
  ENSP ID: ENSP00000443428
  MOD_RES (1)..(1): Any amino acid
XGVPDMTWGQRVTAVVTLREGHSLSHRELKEWARLKEHPTKRRENSILNIGRKRNLASGMRALTGRMAARRAAVSSEVSSSDETDNSLKRHKLPRLTQTLKQTEQF

SEQ ID NO: 1944 - protein, 190 aa, Homo sapiens
  Payload ID: 503;
  Gene Symbol: ACSF3;
  Gene Name: acyl-CoA synthetase family member 3;
  ENSP ID: ENSP00000445397
MMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTTAVRLPGSVGTPLPGVQVRIVSENPQREACSYTIHAEGDERGTKVTPGFEEKEGELLVRGPSVFREYWNKPEETKSAFTLDGWFKT

SEQ ID NO: 1945 - protein, 144 aa, Homo sapiens
  Payload ID: 503;
  Gene Symbol: ACSF3;
  Gene Name: acyl-CoA synthetase family member 3;
  ENSP ID: ENSP00000445870
LVHKWAWTKDDVILHVLPLHHVHGVVNALLCPLWVGATCVMMPEFSPQQVWEKFLSSETPRINVFMAVPTIYTKLMEYYDRHFTQPHAQDFLRAVCEEKIRFRGDPTAWSTGAHCLRKPTEGSLLLHHPRRGRREGDQGPQPML

SEQ ID NO: 1946 - protein, 368 aa, Homo sapiens
  Payload ID: 503;
  Gene Symbol: ACSF3;
  Gene Name: acyl-CoA synthetase family member 3;
  ENSP ID: ENSP00000446281
MLPHVVLTFRRLGCALASCRLAPARHRGSGLLHTAPVARSDRSAPVFTRALAFGDRIALVDQHGRHTYRELYSRSLRLSQEICRLCGCVGGDLREERVSFLCANDASYVVAQWASWMSGGVAVPLYRKHPAAQLEYVICDSQSSVVLASQEYLELLSPVVRKLGVPLLPLTPAIYTGAVEEPAEVPVPEQGWRNKGAMIIYTSGTTGRPKGVLSTHQNIRAVVTGLVHKWAWTKDDVILHVLPLHHVHGVVNALLCPLWVGATCVMMPEFSPQQVWEKFLSSETPRINVFMAVPTIYTKLMEYYDRHFTQPHAQDFLRAVCEEKIRFRGDPTAWSTGAHCLRKPTEGSLLLHHPRRGRREGDQGDPRV

SEQ ID NO: 1947 - protein, 28 aa, Homo sapiens
  Payload ID: 503;
  Gene Symbol: ACSF3;
  Gene Name: acyl-CoA synthetase family member 3;
  ENSP ID: ENSP00000457301
MLPHVVLTFRRLGCALASCRLAPARHRG

SEQ ID NO: 1948 - protein, 576 aa, Homo sapiens; identical to SEQ ID NO: 1936
  Payload ID: 503;
  Gene Symbol: ACSF3;
  Gene Name: acyl-CoA synthetase family member 3;
  Uniprot ID:  Q4G176;
  ENSP ID: ENSP00000479130

SEQ ID NO: 1949 - protein, 698 aa, Homo sapiens
  Payload ID: 504;
  Gene Symbol: ACSL1;
  Gene Name: acyl-CoA synthetase long-chain family member 1;
  Uniprot ID:  P33121;
  ENSP ID: ENSP00000281455
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 1950 - protein, 527 aa, Homo sapiens
  Payload ID: 504;
  Gene Symbol: ACSL1;
  Gene Name: acyl-CoA synthetase long-chain family member 1;
  ENSP ID: ENSP00000407165
MVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 1951 - protein, 698 aa, Homo sapiens; identical to SEQ ID NO: 1949
  Payload ID: 504;
  Gene Symbol: ACSL1;
  Gene Name: acyl-CoA synthetase long-chain family member 1;
  Uniprot ID:  P33121;
  ENSP ID: ENSP00000422607

SEQ ID NO: 1952 - protein, 388 aa, Homo sapiens
  Payload ID: 504;
  Gene Symbol: ACSL1;
  Gene Name: acyl-CoA synthetase long-chain family member 1;
  ENSP ID: ENSP00000424935
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRVSSKQRSPRTEH

SEQ ID NO: 1953 - protein, 698 aa, Homo sapiens; identical to SEQ ID NO: 1949
  Payload ID: 504;
  Gene Symbol: ACSL1;
  Gene Name: acyl-CoA synthetase long-chain family member 1;
  Uniprot ID:  P33121;
  ENSP ID: ENSP00000425006

SEQ ID NO: 1954 - protein, 294 aa, Homo sapiens
  Payload ID: 504;
  Gene Symbol: ACSL1;
  Gene Name: acyl-CoA synthetase long-chain family member 1;
  ENSP ID: ENSP00000425098
KRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 1955 - protein, 94 aa, Homo sapiens
  Payload ID: 504;
  Gene Symbol: ACSL1;
  Gene Name: acyl-CoA synthetase long-chain family member 1;
  ENSP ID: ENSP00000425640
  MOD_RES (1)..(1): Any amino acid
XLGRANRRKPKPPAPEDLAVICFTSGTTGNPKGAMVTHRNIVSDCSAFVKATECVMLCHGAKIGFFQGDIRLLMDDLKVLQPTVFPVVPRLLNR

SEQ ID NO: 1956 - protein, 698 aa, Homo sapiens
  Payload ID: 504;
  Gene Symbol: ACSL1;
  Gene Name: acyl-CoA synthetase long-chain family member 1;
  Uniprot ID:  P33121;
  ENSP ID: ENSP00000426150
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATEKALPLSASDTHISYLPLAHIYEQLLKCVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 1957 - protein, 664 aa, Homo sapiens
  Payload ID: 504;
  Gene Symbol: ACSL1;
  Gene Name: acyl-CoA synthetase long-chain family member 1;
  ENSP ID: ENSP00000426244
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 1958 - protein, 126 aa, Homo sapiens
  Payload ID: 504;
  Gene Symbol: ACSL1;
  Gene Name: acyl-CoA synthetase long-chain family member 1;
  ENSP ID: ENSP00000426491
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSRSLRPLCVHCNFPRVGPKAHWTL

SEQ ID NO: 1959 - protein, 527 aa, Homo sapiens; identical to SEQ ID NO: 1950
  Payload ID: 504;
  Gene Symbol: ACSL1;
  Gene Name: acyl-CoA synthetase long-chain family member 1;
  ENSP ID: ENSP00000485264

SEQ ID NO: 1960 - protein, 720 aa, Homo sapiens
  Payload ID: 505;
  Gene Symbol: ACSL3;
  Gene Name: acyl-CoA synthetase long-chain family member 3;
  Uniprot ID:  O95573;
  ENSP ID: ENSP00000350012
MNNHVSSKPSTMKLKHTINPILLYFIHFLISLYTILTYIPFYFFSESRQEKSNRIKAKPVNSKPDSAYRSVNSLDGLASVLYPGCDTLDKVFTYAKNKFKNKRLLGTREVLNEEDEVQPNGKIFKKVILGQYNWLSYEDVFVRAFNFGNGLQMLGQKPKTNIAIFCETRAEWMIAAQACFMYNFQLVTLYATLGGPAIVHALNETEVTNIITSKELLQTKLKDIVSLVPRLRHIITVDGKPPTWSEFPKGIIVHTMAAVEALGAKASMENQPHSKPLPSDIAVIMYTSGSTGLPKGVMISHSNIIAGITGMAERIPELGEEDVYIGYLPLAHVLELSAELVCLSHGCRIGYSSPQTLADQSSKIKKGSKGDTSMLKPTLMAAVPEIMDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFFEDENGQRWLCTGDIGEFEPDGCLKIIDRKKDLVKLQAGEYVSLGKVEAALKNLPLVDNICAYANSYHSYVIGFVVPNQKELTELARKKGLKGTWEELCNSCEMENEVLKVLSEAAISASLEKFEIPVKIRLSPEPWTPETGLVTDAFKLKRKELKTHYQADIERMYGRK

SEQ ID NO: 1961 - protein, 720 aa, Homo sapiens; identical to SEQ ID NO: 1960
  Payload ID: 505;
  Gene Symbol: ACSL3;
  Gene Name: acyl-CoA synthetase long-chain family member 3;
  Uniprot ID:  O95573;
  ENSP ID: ENSP00000375918

SEQ ID NO: 1962 - protein, 18 aa, Homo sapiens
  Payload ID: 505;
  Gene Symbol: ACSL3;
  Gene Name: acyl-CoA synthetase long-chain family member 3;
  ENSP ID: ENSP00000385157
  MOD_RES (1)..(1): Any amino acid
XEQISKGRNTPLCDRWIL

SEQ ID NO: 1963 - protein, 88 aa, Homo sapiens
  Payload ID: 505;
  Gene Symbol: ACSL3;
  Gene Name: acyl-CoA synthetase long-chain family member 3;
  ENSP ID: ENSP00000416913
MNNHVSSKPSTMKLKHTINPILLYFIHFLISLYTILTYIPFYFFSESRQEKSNRIKAKPVNSKPDSAYRSVNSLDGLASVLYPGCDTL

SEQ ID NO: 1964 - protein, 95 aa, Homo sapiens
  Payload ID: 505;
  Gene Symbol: ACSL3;
  Gene Name: acyl-CoA synthetase long-chain family member 3;
  ENSP ID: ENSP00000438342
MNNHVSSKPSTMKLKHTINPILLYFIHFLISLYTILTYIPFYFFSESRQEKSNRIKAKPVNSKPDSAYRSVNSLDGLASVLYPGCDTLDKVFTYA

SEQ ID NO: 1965 - protein, 141 aa, Homo sapiens
  Payload ID: 505;
  Gene Symbol: ACSL3;
  Gene Name: acyl-CoA synthetase long-chain family member 3;
  ENSP ID: ENSP00000441643
MLGQKPKTNIAIFCETRAEWMIAAQACFMYNFQLVTLYATLGGPAIVHALNETEVTNIITSKELLQTKLKDIVSLVPRLRHIITVDGKPPTWSEFPKGIIVHTMAAVEALGAKASMENQPHSKPLPSDIAVIMYTSGSTGL

SEQ ID NO: 1966 - protein, 670 aa, Homo sapiens
  Payload ID: 506;
  Gene Symbol: ACSL4;
  Gene Name: acyl-CoA synthetase long-chain family member 4;
  Uniprot ID:  O60488;
  ENSP ID: ENSP00000262835
MAKRIKAKPTSDKPGSPYRSVTHFDSLAVIDIPGADTLDKLFDHAVSKFGKKDSLGTREILSEENEMQPNGKVFKKLILGNYKWMNYLEVNRRVNNFGSGLTALGLKPKNTIAIFCETRAEWMIAAQTCFKYNFPLVTLYATLGKEAVVHGLNESEASYLITSVELLESKLKTALLDISCVKHIIYVDNKAINKAEYPEGFEIHSMQSVEELGSNPENLGIPPSRPTPSDMAIVMYTSGSTGRPKGVMMHHSNLIAGMTGQCERIPGLGPKDTYIGYLPLAHVLELTAEISCFTYGCRIGYSSPLTLSDQSSKIKKGSKGDCTVLKPTLMAAVPEIMDRIYKNVMSKVQEMNYIQKTLFKIGYDYKLEQIKKGYDAPLCNLLLFKKVKALLGGNVRMMLSGGAPLSPQTHRFMNVCFCCPIGQGYGLTESCGAGTVTEVTDYTTGRVGAPLICCEIKLKDWQEGGYTINDKPNPRGEIVIGGQNISMGYFKNEEKTAEDYSVDENGQRWFCTGDIGEFHPDGCLQIIDRKKDLVKLQAGEYVSLGKVEAALKNCPLIDNICAFAKSDQSYVISFVVPNQKRLTLLAQQKGVEGTWVDICNNPAMEAEILKEIREAANAMKLERFEIPIKVRLSPEPWTPETGLVTDAFKLKRKELRNHYLKDIERMYGGK

SEQ ID NO: 1967 - protein, 711 aa, Homo sapiens
  Payload ID: 506;
  Gene Symbol: ACSL4;
  Gene Name: acyl-CoA synthetase long-chain family member 4;
  Uniprot ID:  O60488;
  ENSP ID: ENSP00000339787
MKLKLNVLTIILLPVHLLITIYSALIFIPWYFLTNAKKKNAMAKRIKAKPTSDKPGSPYRSVTHFDSLAVIDIPGADTLDKLFDHAVSKFGKKDSLGTREILSEENEMQPNGKVFKKLILGNYKWMNYLEVNRRVNNFGSGLTALGLKPKNTIAIFCETRAEWMIAAQTCFKYNFPLVTLYATLGKEAVVHGLNESEASYLITSVELLESKLKTALLDISCVKHIIYVDNKAINKAEYPEGFEIHSMQSVEELGSNPENLGIPPSRPTPSDMAIVMYTSGSTGRPKGVMMHHSNLIAGMTGQCERIPGLGPKDTYIGYLPLAHVLELTAEISCFTYGCRIGYSSPLTLSDQSSKIKKGSKGDCTVLKPTLMAAVPEIMDRIYKNVMSKVQEMNYIQKTLFKIGYDYKLEQIKKGYDAPLCNLLLFKKVKALLGGNVRMMLSGGAPLSPQTHRFMNVCFCCPIGQGYGLTESCGAGTVTEVTDYTTGRVGAPLICCEIKLKDWQEGGYTINDKPNPRGEIVIGGQNISMGYFKNEEKTAEDYSVDENGQRWFCTGDIGEFHPDGCLQIIDRKKDLVKLQAGEYVSLGKVEAALKNCPLIDNICAFAKSDQSYVISFVVPNQKRLTLLAQQKGVEGTWVDICNNPAMEAEILKEIREAANAMKLERFEIPIKVRLSPEPWTPETGLVTDAFKLKRKELRNHYLKDIERMYGGK

SEQ ID NO: 1968 - protein, 711 aa, Homo sapiens; identical to SEQ ID NO: 1967
  Payload ID: 506;
  Gene Symbol: ACSL4;
  Gene Name: acyl-CoA synthetase long-chain family member 4;
  Uniprot ID:  O60488;
  ENSP ID: ENSP00000419171

SEQ ID NO: 1969 - protein, 126 aa, Homo sapiens
  Payload ID: 506;
  Gene Symbol: ACSL4;
  Gene Name: acyl-CoA synthetase long-chain family member 4;
  ENSP ID: ENSP00000421425
MKLKLNVLTIILLPVHLLITIYSALIFIPWYFLTNAKKKNAMAKRIKAKPTSDKPGSPYRSVTHFDSLAVIDIPGADTLDKLFDHAVSKFGKKDSLGTREILSEENEMQPNGKVFKKLILGNYKWM

SEQ ID NO: 1970 - protein, 54 aa, Homo sapiens
  Payload ID: 506;
  Gene Symbol: ACSL4;
  Gene Name: acyl-CoA synthetase long-chain family member 4;
  ENSP ID: ENSP00000423077
MKLKLNVLTIILLPVHLLITIYSALIFIPWYFLTNAKKKNAMAKRIKAKPTSDK

SEQ ID NO: 1971 - protein, 156 aa, Homo sapiens
  Payload ID: 506;
  Gene Symbol: ACSL4;
  Gene Name: acyl-CoA synthetase long-chain family member 4;
  ENSP ID: ENSP00000423539
  MOD_RES (1)..(1): Any amino acid
XTLFKIGYDYKLEQIKKGYDAPLCNLLLFKKVKALLGGNVRMMLSGGAPLSPQTHRFMNVCFCCPIGQGYGLTESCGAGTVTEVTDYTTGRVGAPLICCEIKLKDWQEGGYTINDKPNPRGEIVIGGQNISMGYFKNEEKTAEDYSVDENGQRNLG

SEQ ID NO: 1972 - protein, 154 aa, Homo sapiens
  Payload ID: 506;
  Gene Symbol: ACSL4;
  Gene Name: acyl-CoA synthetase long-chain family member 4;
  ENSP ID: ENSP00000424808
MAKRIKAKPTSDKPGSPYRSVTHFDSLAVIDIPGADTLDKLFDHAVSKFGKKDSLGTREILSEENEMQPNGKVFKKLILGNYKWMNYLEVNRRVNNFGSGLTALGLKPKNTIAIFCETRAEWMIAAQTCFKYNFPLVTLYATLGKEAVVHGLNE

SEQ ID NO: 1973 - protein, 128 aa, Homo sapiens
  Payload ID: 506;
  Gene Symbol: ACSL4;
  Gene Name: acyl-CoA synthetase long-chain family member 4;
  ENSP ID: ENSP00000425378
MKLKLNVLTIILLPVHLLITIYSALIFIPWYFLTNAKKKNAMAKRIKAKPTSDKPGSPYRSVTHFDSLAVIDIPGADTLDKLFDHAVSKFGKKDSLGTREILSEENEMQPNGKVFKKLILGNYKWMNY

SEQ ID NO: 1974 - protein, 145 aa, Homo sapiens
  Payload ID: 506;
  Gene Symbol: ACSL4;
  Gene Name: acyl-CoA synthetase long-chain family member 4;
  ENSP ID: ENSP00000425408
MKLKLNVLTIILLPVHLLITIYSALIFIPWYFLTNAKKKNAMAKRIKAKPTSDKPGSPYRSVTHFDSLAVIDIPGADTLDKLFDHAVSKFGKKDSLGTREILSEENEMQPNGKVFKKLILGNYKWMNYLEVNRRVNNFGSGLTAL

SEQ ID NO: 1975 - protein, 683 aa, Homo sapiens
  Payload ID: 507;
  Gene Symbol: ACSL5;
  Gene Name: acyl-CoA synthetase long-chain family member 5;
  Uniprot ID:  Q9ULC5;
  ENSP ID: ENSP00000346223
MLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 1976 - protein, 683 aa, Homo sapiens; identical to SEQ ID NO: 1975
  Payload ID: 507;
  Gene Symbol: ACSL5;
  Gene Name: acyl-CoA synthetase long-chain family member 5;
  Uniprot ID:  Q9ULC5;
  ENSP ID: ENSP00000346680

SEQ ID NO: 1977 - protein, 739 aa, Homo sapiens
  Payload ID: 507;
  Gene Symbol: ACSL5;
  Gene Name: acyl-CoA synthetase long-chain family member 5;
  Uniprot ID:  Q9ULC5;
  ENSP ID: ENSP00000348429
MDALKPPCLWRNHERGKKDRDSCGRKNSEPGSPHSLEALRDAAPSQGLNFLLLFTKMLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 1978 - protein, 683 aa, Homo sapiens; identical to SEQ ID NO: 1975
  Payload ID: 507;
  Gene Symbol: ACSL5;
  Gene Name: acyl-CoA synthetase long-chain family member 5;
  Uniprot ID:  Q9ULC5;
  ENSP ID: ENSP00000376796

SEQ ID NO: 1979 - protein, 659 aa, Homo sapiens
  Payload ID: 507;
  Gene Symbol: ACSL5;
  Gene Name: acyl-CoA synthetase long-chain family member 5;
  Uniprot ID:  Q9ULC5;
  ENSP ID: ENSP00000403647
MLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVKAIFLHPEPFSIENGLLTPTLKAKRGELSKYFRTQIDSLYEHIQD

SEQ ID NO: 1980 - protein, 722 aa, Homo sapiens
  Payload ID: 508;
  Gene Symbol: ACSL6;
  Gene Name: acyl-CoA synthetase long-chain family member 6;
  Uniprot ID:  Q9UKU0;
  ENSP ID: ENSP00000296869
MLTFFLVSGGSLWLFVEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 1981 - protein, 622 aa, Homo sapiens
  Payload ID: 508;
  Gene Symbol: ACSL6;
  Gene Name: acyl-CoA synthetase long-chain family member 6;
  Uniprot ID:  Q9UKU0;
  ENSP ID: ENSP00000349608
MQTQEILRILRLPELGDLGQFFRSLSATTLDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 1982 - protein, 697 aa, Homo sapiens
  Payload ID: 508;
  Gene Symbol: ACSL6;
  Gene Name: acyl-CoA synthetase long-chain family member 6;
  Uniprot ID:  Q9UKU0;
  ENSP ID: ENSP00000368542
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 1983 - protein, 697 aa, Homo sapiens
  Payload ID: 508;
  Gene Symbol: ACSL6;
  Gene Name: acyl-CoA synthetase long-chain family member 6;
  Uniprot ID:  Q9UKU0;
  ENSP ID: ENSP00000368546
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 1984 - protein, 708 aa, Homo sapiens
  Payload ID: 508;
  Gene Symbol: ACSL6;
  Gene Name: acyl-CoA synthetase long-chain family member 6;
  Uniprot ID:  Q9UKU0;
  ENSP ID: ENSP00000368548
MPEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 1985 - protein, 622 aa, Homo sapiens; identical to SEQ ID NO: 1981
  Payload ID: 508;
  Gene Symbol: ACSL6;
  Gene Name: acyl-CoA synthetase long-chain family member 6;
  Uniprot ID:  Q9UKU0;
  ENSP ID: ENSP00000368557

SEQ ID NO: 1986 - protein, 722 aa, Homo sapiens
  Payload ID: 508;
  Gene Symbol: ACSL6;
  Gene Name: acyl-CoA synthetase long-chain family member 6;
  Uniprot ID:  Q9UKU0;
  ENSP ID: ENSP00000368566
MLTFFLVSGGSLWLFVEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 1987 - protein, 152 aa, Homo sapiens
  Payload ID: 508;
  Gene Symbol: ACSL6;
  Gene Name: acyl-CoA synthetase long-chain family member 6;
  ENSP ID: ENSP00000388424
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGV

SEQ ID NO: 1988 - protein, 99 aa, Homo sapiens
  Payload ID: 508;
  Gene Symbol: ACSL6;
  Gene Name: acyl-CoA synthetase long-chain family member 6;
  ENSP ID: ENSP00000389189
MQTQEILRILRLPELGDLGQFFRSLSATTLDSGGARRSVIGSGPQLLTHYYDDARTMYQVFRRGLSISGNGPCLGFRKPKQPYQWLSYQEVADRAEFLG

SEQ ID NO: 1989 - protein, 134 aa, Homo sapiens
  Payload ID: 508;
  Gene Symbol: ACSL6;
  Gene Name: acyl-CoA synthetase long-chain family member 6;
  ENSP ID: ENSP00000394810
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLG

SEQ ID NO: 1990 - protein, 365 aa, Homo sapiens
  Payload ID: 508;
  Gene Symbol: ACSL6;
  Gene Name: acyl-CoA synthetase long-chain family member 6;
  ENSP ID: ENSP00000397507
MQTQEILRILRLPELGDLGQFFRSLSATTLDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAE

SEQ ID NO: 1991 - protein, 144 aa, Homo sapiens
  Payload ID: 508;
  Gene Symbol: ACSL6;
  Gene Name: acyl-CoA synthetase long-chain family member 6;
  ENSP ID: ENSP00000398381
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKA

SEQ ID NO: 1992 - protein, 213 aa, Homo sapiens
  Payload ID: 508;
  Gene Symbol: ACSL6;
  Gene Name: acyl-CoA synthetase long-chain family member 6;
  ENSP ID: ENSP00000398423
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHV

SEQ ID NO: 1993 - protein, 677 aa, Homo sapiens
  Payload ID: 508;
  Gene Symbol: ACSL6;
  Gene Name: acyl-CoA synthetase long-chain family member 6;
  ENSP ID: ENSP00000413329
MQTQEILRILRLPELGDLGQFFRSLSATTLDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTGLSCQEGASATASTQADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 1994 - protein, 712 aa, Homo sapiens
  Payload ID: 508;
  Gene Symbol: ACSL6;
  Gene Name: acyl-CoA synthetase long-chain family member 6;
  Uniprot ID:  Q9UKU0;
  ENSP ID: ENSP00000442124
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTGLSCQEGASATASTQADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 1995 - protein, 577 aa, Homo sapiens
  Payload ID: 509;
  Gene Symbol: ACSM1;
  Gene Name: acyl-CoA synthetase medium-chain family member 1;
  Uniprot ID:  Q08AH1;
  ENSP ID: ENSP00000301956
MQWLMRFRTLWGIHKSFHNIHPAPSQLRCRSLSEFGAPRWNDYEVPEEFNFASYVLDYWAQKEKEGKRGPNPAFWWVNGQGDEVKWSFREMGDLTRRVANVFTQTCGLQQGDHLALMLPRVPEWWLVAVGCMRTGIIFIPATILLKAKDILYRLQLSKAKGIVTIDALASEVDSIASQCPSLKTKLLVSDHSREGWLDFRSLVKSASPEHTCVKSKTLDPMVIFFTSGTTGFPKMAKHSHGLALQPSFPGSRKLRSLKTSDVSWCLSDSGWIVATIWTLVEPWTAGCTVFIHHLPQFDTKVIIQTLLKYPINHFWGVSSIYRMILQQDFTSIRFPALEHCYTGGEVVLPKDQEEWKRRTGLLLYENYGQSETGLICATYWGMKIKPGFMGKATPPYDVQVIDDKGSILPPNTEGNIGIRIKPVRPVSLFMCYEGDPEKTAKVECGDFYNTGDRGKMDEEGYICFLGRSDDIINASGYRIGPAEVESALVEHPAVAESAVVGSPDPIRGEVVKAFIVLTPQFLSHDKDQLTKELQQHVKSVTAPYKYPRKVEFVSELPKTITGKIERKELRKKETGQM

SEQ ID NO: 1996 - protein, 577 aa, Homo sapiens; identical to SEQ ID NO: 1995
  Payload ID: 509;
  Gene Symbol: ACSM1;
  Gene Name: acyl-CoA synthetase medium-chain family member 1;
  Uniprot ID:  Q08AH1;
  ENSP ID: ENSP00000428047

SEQ ID NO: 1997 - protein, 249 aa, Homo sapiens
  Payload ID: 509;
  Gene Symbol: ACSM1;
  Gene Name: acyl-CoA synthetase medium-chain family member 1;
  ENSP ID: ENSP00000428098
  MOD_RES (1)..(1): Any amino acid
XQFDTKVIIQTLLKYPINHFWGVSSIYRMILQQDFTSIRFPALEHCYTGGEVVLPKDQEEWKRRTGLLLYENYGQSETGLICATYWGMKIKPGFMGKATPPYDVQGDPEKTAKVECGDFYNTGDRGKMDEEGYICFLGRSDDIINASGYRIGPAEVESALVEHPAVAESAVVGSPDPIRGEVVKAFIVLTPQFLSHDKDQLTKELQQHVKSVTAPYKYPRKVEFVSELPKTITGKIERKELRKKETGQM

SEQ ID NO: 1998 - protein, 204 aa, Homo sapiens
  Payload ID: 509;
  Gene Symbol: ACSM1;
  Gene Name: acyl-CoA synthetase medium-chain family member 1;
  Uniprot ID:  Q08AH1;
  ENSP ID: ENSP00000428650
MQWLMRFRTLWGIHKSFHNIHPAPSQLRCRSLSEFGAPRWNDYEVPEEFNFASYVLDYWAQKEKEGKRGPNPAFWWVNGQGDEVKWSFREMGDLTRRVANVFTQTCGLQQGDHLALMLPRVPEWWLVAVGCMRTGIIFIPATILLKAKDILYRLQLSKAKGIVTIDALASEVDSIASQCPSLKTKLLVSDHSREGWLDFRSLVK

SEQ ID NO: 1999 - protein, 154 aa, Homo sapiens
  Payload ID: 509;
  Gene Symbol: ACSM1;
  Gene Name: acyl-CoA synthetase medium-chain family member 1;
  ENSP ID: ENSP00000428830
MQWLMRFRTLWGIHKSFHNIHPAPSQLRCRSLSEFGAPRWNDYEVPEEFNFASYVLDYWAQKEKEGKRGPNPAFWWVNGQGDEVKWSFREMGDLTRRVANVFTQTCGLQQGDHLALMLPRVPEWWLVAVGCMRTGIIFIPATILLKAKDILYRL

SEQ ID NO: 2000 - protein, 577 aa, Homo sapiens
  Payload ID: 510;
  Gene Symbol: ACSM2A;
  Gene Name: acyl-CoA synthetase medium-chain family member 2A;
  Uniprot ID:  Q08AH3;
  ENSP ID: ENSP00000219054
MHWLRKVQGLCTLWGTQMSSRTLYINSRQLVSLQWGHQEVPAKFNFASDVLDHWADMEKAGKRLPSPALWWVNGKGKELMWNFRELSENSQQAANVLSGACGLQRGDRVAVVLPRVPEWWLVILGCIRAGLIFMPGTIQMKSTDILYRLQMSKAKAIVAGDEVIQEVDTVASECPSLRIKLLVSEKSCDGWLNFKKLLNEASTTHHCVETGSQEASAIYFTSGTSGLPKMAEHSYSSLGLKAKMDAGWTGLQASDIMWTISDTGWILNILCSLMEPWALGACTFVHLLPKFDPLVILKTLSSYPIKSMMGAPIVYRMLLQQDLSSYKFPHLQNCVTVGESLLPETLENWRAQTGLDIRESYGQTETGLTCMVSKTMKIKPGYMGTAASCYDVQIIDDKGNVLPPGTEGDIGIRVKPIRPIGIFSGYVDNPDKTAANIRGDFWLLGDRGIKDEDGYFQFMGRANDIINSSGYRIGPSEVENALMEHPAVVETAVISSPDPVRGEVVKAFVVLASQFLSHDPEQLTKELQQHVKSVTAPYKYPRKIEFVLNLPKTVTGKIQRAKLRDKEWKMSGKARAQ

SEQ ID NO: 2001 - protein, 577 aa, Homo sapiens; identical to SEQ ID NO: 2000
  Payload ID: 510;
  Gene Symbol: ACSM2A;
  Gene Name: acyl-CoA synthetase medium-chain family member 2A;
  Uniprot ID:  Q08AH3;
  ENSP ID: ENSP00000379411

SEQ ID NO: 2002 - protein, 498 aa, Homo sapiens
  Payload ID: 510;
  Gene Symbol: ACSM2A;
  Gene Name: acyl-CoA synthetase medium-chain family member 2A;
  ENSP ID: ENSP00000392169
MWNFRELSENSQQAANVLSGACGLQRGDRVAVVLPRVPEWWLVILGCIRAGLIFMPGTIQMKSTDILYRLQMSKAKAIVAGDEVIQEVDTVASECPSLRIKLLVSEKSCDGWLNFKKLLNEASTTHHCVETGSQEASAIYFTSGTSGLPKMAEHSYSSLGLKAKMDAGWTGLQASDIMWTISDTGWILNILCSLMEPWALGACTFVHLLPKFDPLVILKTLSSYPIKSMMGAPIVYRMLLQQDLSSYKFPHLQNCVTVGESLLPETLENWRAQTGLDIRESYGQTETGLTCMVSKTMKIKPGYMGTAASCYDVQIIDDKGNVLPPGTEGDIGIRVKPIRPIGIFSGYVDNPDKTAANIRGDFWLLGDRGIKDEDGYFQFMGRANDIINSSGYRIGPSEVENALMEHPAVVETAVISSPDPVRGEVVKAFVVLASQFLSHDPEQLTKELQQHVKSVTAPYKYPRKIEFVLNLPKTVTGKIQRAKLRDKEWKMSGKARAQ

SEQ ID NO: 2003 - protein, 577 aa, Homo sapiens; identical to SEQ ID NO: 2000
  Payload ID: 510;
  Gene Symbol: ACSM2A;
  Gene Name: acyl-CoA synthetase medium-chain family member 2A;
  Uniprot ID:  Q08AH3;
  ENSP ID: ENSP00000459451

SEQ ID NO: 2004 - protein, 118 aa, Homo sapiens
  Payload ID: 510;
  Gene Symbol: ACSM2A;
  Gene Name: acyl-CoA synthetase medium-chain family member 2A;
  ENSP ID: ENSP00000460031
MHWLRKVQGLCTLWGTQMSSRTLYINSRQLVSLQWGHQEVPAKFNFASDVLDHWADMEKAGKRLPSPALWWVNGKGKELMWNFRELSENSQQAANVLSGACGLQRGDRVAVVLPRVPE

SEQ ID NO: 2005 - protein, 61 aa, Homo sapiens
  Payload ID: 510;
  Gene Symbol: ACSM2A;
  Gene Name: acyl-CoA synthetase medium-chain family member 2A;
  ENSP ID: ENSP00000460153
MWNFRELSENSQQAANVLSGACGLQRGDRVAVVLPRVPEWWLVILGCIRAGLIFMPGTIQM

SEQ ID NO: 2006 - protein, 577 aa, Homo sapiens; identical to SEQ ID NO: 2000
  Payload ID: 510;
  Gene Symbol: ACSM2A;
  Gene Name: acyl-CoA synthetase medium-chain family member 2A;
  Uniprot ID:  Q08AH3;
  ENSP ID: ENSP00000460349

SEQ ID NO: 2007 - protein, 208 aa, Homo sapiens
  Payload ID: 510;
  Gene Symbol: ACSM2A;
  Gene Name: acyl-CoA synthetase medium-chain family member 2A;
  ENSP ID: ENSP00000460884
MHWLRKVQGLCTLWGTQMSSRTLYINSRQLVSLQWGHQEVPAKFNFASDVLDHWADMEKAGKRLPSPALWWVNGKGKELMWNFRELSENSQQAANVLSGACGLQRGDRVAVVLPRVPEWWLVILGCIRAGLIFMPGTIQMKSTDILYRLQMSKAKAIVAGDEVIQEVDTVASECPSLRIKLLVSEKSCDGWLNFKKLLKYKVRHRDVK

SEQ ID NO: 2008 - protein, 105 aa, Homo sapiens
  Payload ID: 510;
  Gene Symbol: ACSM2A;
  Gene Name: acyl-CoA synthetase medium-chain family member 2A;
  ENSP ID: ENSP00000460948
MHWLRKVQGLCTLWGTQMSSRTLYINSRQLVSLQWGHQEVPAKFNFASDVLDHWADMEKAGKRLPSPALWWVNGKGKELMWNFRELSENSQQAANVLSGACGLQR

SEQ ID NO: 2009 - protein, 577 aa, Homo sapiens
  Payload ID: 511;
  Gene Symbol: ACSM2B;
  Gene Name: acyl-CoA synthetase medium-chain family member 2B;
  Uniprot ID:  Q68CK6;
  ENSP ID: ENSP00000327453
MHWLRKVQGLCTLWGTQMSSRTLYINSRQLVSLQWGHQEVPAKFNFASDVLDHWADMEKAGKRLPSPALWWVNGKGKELMWNFRELSENSQQAANILSGACGLQRGDRVAVMLPRVPEWWLVILGCIRAGLIFMPGTIQMKSTDILYRLQMSKAKAIVAGDEVIQEVDTVASECPSLRIKLLVSEKSCDGWLNFKKLLNEASTTHHCVETGSQEASAIYFTSGTSGLPKMAEHSYSSLGLKAKMDAGWTGLQASDIMWTISDTGWILNILGSLLESWTLGACTFVHLLPKFDPLVILKTLSSYPIKSMMGAPIVYRMLLQQDLSSYKFPHLQNCLAGGESLLPETLENWRAQTGLDIREFYGQTETGLTCMVSKTMKIKPGYMGTAASCYDVQVIDDKGNVLPPGTEGDIGIRVKPIRPIGIFSGYVENPDKTAANIRGDFWLLGDRGIKDEDGYFQFMGRADDIINSSGYRIGPSEVENALMKHPAVVETAVISSPDPVRGEVVKAFVILASQFLSHDPEQLTKELQQHVKSVTAPYKYPRKIEFVLNLPKTVTGKIQRTKLRDKEWKMSGKARAQ

SEQ ID NO: 2010 - protein, 577 aa, Homo sapiens; identical to SEQ ID NO: 2009
  Payload ID: 511;
  Gene Symbol: ACSM2B;
  Gene Name: acyl-CoA synthetase medium-chain family member 2B;
  Uniprot ID:  Q68CK6;
  ENSP ID: ENSP00000390378

SEQ ID NO: 2011 - protein, 118 aa, Homo sapiens
  Payload ID: 511;
  Gene Symbol: ACSM2B;
  Gene Name: acyl-CoA synthetase medium-chain family member 2B;
  ENSP ID: ENSP00000454247
MHWLRKVQGLCTLWGTQMSSRTLYINSRQLVSLQWGHQEVPAKFNFASDVLDHWADMEKAGKRLPSPALWWVNGKGKELMWNFRELSENSQQAANILSGACGLQRGDRVAVMLPRVPE

SEQ ID NO: 2012 - protein, 208 aa, Homo sapiens
  Payload ID: 511;
  Gene Symbol: ACSM2B;
  Gene Name: acyl-CoA synthetase medium-chain family member 2B;
  ENSP ID: ENSP00000454887
MHWLRKVQGLCTLWGTQMSSRTLYINSRQLVSLQWGHQEVPAKFNFASDVLDHWADMEKAGKRLPSPALWWVNGKGKELMWNFRELSENSQQAANILSGACGLQRGDRVAVMLPRVPEWWLVILGCIRAGLIFMPGTIQMKSTDILYRLQMSKAKAIVAGDEVIQEVDTVASECPSLRIKLLVSEKSCDGWLNFKKLLKYKVRHREVK

SEQ ID NO: 2013 - protein, 577 aa, Homo sapiens; identical to SEQ ID NO: 2009
  Payload ID: 511;
  Gene Symbol: ACSM2B;
  Gene Name: acyl-CoA synthetase medium-chain family member 2B;
  Uniprot ID:  Q68CK6;
  ENSP ID: ENSP00000454995

SEQ ID NO: 2014 - protein, 110 aa, Homo sapiens
  Payload ID: 511;
  Gene Symbol: ACSM2B;
  Gene Name: acyl-CoA synthetase medium-chain family member 2B;
  ENSP ID: ENSP00000455137
  MOD_RES (1)..(1): Any amino acid
XSGYVENPDKTAANIRGDFWLLGDRGIKDEDGYFQFMGRAFVILASQFLSHDPEQLTKELQQHVKSVTAPYKYPRKIEFVLNLPKTVTGKIQRTKLRDKEWKMSGKARAQ

SEQ ID NO: 2015 - protein, 61 aa, Homo sapiens
  Payload ID: 511;
  Gene Symbol: ACSM2B;
  Gene Name: acyl-CoA synthetase medium-chain family member 2B;
  ENSP ID: ENSP00000455190
MWNFRELSENSQQAANILSGACGLQRGDRVAVMLPRVPEWWLVILGCIRAGLIFMPGTIQM

SEQ ID NO: 2016 - protein, 105 aa, Homo sapiens
  Payload ID: 511;
  Gene Symbol: ACSM2B;
  Gene Name: acyl-CoA synthetase medium-chain family member 2B;
  ENSP ID: ENSP00000455658
MHWLRKVQGLCTLWGTQMSSRTLYINSRQLVSLQWGHQEVPAKFNFASDVLDHWADMEKAGKRLPSPALWWVNGKGKELMWNFRELSENSQQAANILSGACGLQR

SEQ ID NO: 2017 - protein, 149 aa, Homo sapiens
  Payload ID: 511;
  Gene Symbol: ACSM2B;
  Gene Name: acyl-CoA synthetase medium-chain family member 2B;
  ENSP ID: ENSP00000456369
WLNFKKLLNEASTTHHCVETGSQEASAIYFTSGTSGLPKMAEHSYSSLGLKAKMDAGWTGLQASDIMWTISDTGWILNILGSLLESWTLGACTFVHLLPKFDPLVILKVFRSTQPIVNQKKFKSTYKLEAPASSCPTFLDQTNVFFKCV

SEQ ID NO: 2018 - protein, 577 aa, Homo sapiens; identical to SEQ ID NO: 2009
  Payload ID: 511;
  Gene Symbol: ACSM2B;
  Gene Name: acyl-CoA synthetase medium-chain family member 2B;
  Uniprot ID:  Q68CK6;
  ENSP ID: ENSP00000456378

SEQ ID NO: 2019 - protein, 498 aa, Homo sapiens
  Payload ID: 511;
  Gene Symbol: ACSM2B;
  Gene Name: acyl-CoA synthetase medium-chain family member 2B;
  ENSP ID: ENSP00000457377
MWNFRELSENSQQAANILSGACGLQRGDRVAVMLPRVPEWWLVILGCIRAGLIFMPGTIQMKSTDILYRLQMSKAKAIVAGDEVIQEVDTVASECPSLRIKLLVSEKSCDGWLNFKKLLNEASTTHHCVETGSQEASAIYFTSGTSGLPKMAEHSYSSLGLKAKMDAGWTGLQASDIMWTISDTGWILNILGSLLESWTLGACTFVHLLPKFDPLVILKTLSSYPIKSMMGAPIVYRMLLQQDLSSYKFPHLQNCLAGGESLLPETLENWRAQTGLDIREFYGQTETGLTCMVSKTMKIKPGYMGTAASCYDVQVIDDKGNVLPPGTEGDIGIRVKPIRPIGIFSGYVENPDKTAANIRGDFWLLGDRGIKDEDGYFQFMGRADDIINSSGYRIGPSEVENALMKHPAVVETAVISSPDPVRGEVVKAFVILASQFLSHDPEQLTKELQQHVKSVTAPYKYPRKIEFVLNLPKTVTGKIQRTKLRDKEWKMSGKARAQ

SEQ ID NO: 2020 - protein, 200 aa, Homo sapiens
  Payload ID: 511;
  Gene Symbol: ACSM2B;
  Gene Name: acyl-CoA synthetase medium-chain family member 2B;
  ENSP ID: ENSP00000478316
EHSYSSLGLKAKMDAGWTGLQASDIMWTISDTGWILNILGSLLESWTLGACTFVHLLPKFDPLVILKTLSSYPIKSMMGAPIVYRMLLQQDLSSYKFPHLQNCLAGGESLLPETLENWRAQTGLDIREFYGQTETGLTCMVSKTMKIKPGYMGTAASCYDVQVIDDKGNVLPPGTEGDIGIRVKPIRPIGIFSGYVVSSP

SEQ ID NO: 2021 - protein, 586 aa, Homo sapiens
  Payload ID: 512;
  Gene Symbol: ACSM3;
  Gene Name: acyl-CoA synthetase medium-chain family member 3;
  Uniprot ID:  Q53FZ2;
  ENSP ID: ENSP00000289416
MLARVTRKMLRHAKCFQRLAIFGSVRALHKDNRTATPQNFSNYESMKQDFKLGIPEYFNFAKDVLDQWTDKEKAGKKPSNPAFWWINRNGEEMRWSFEELGSLSRKFANILSEACSLQRGDRVILILPRVPEWWLANVACLRTGTVLIPGTTQLTQKDILYRLQSSKANCIITNDVLAPAVDAVASKCENLHSKLIVSENSREGWGNLKELMKHASDSHTCVKTKHNEIMAIFFTSGTSGYPKMTAHTHSSFGLGLSVNGRFWLDLTPSDVMWNTSDTGWAKSAWSSVFSPWIQGACVFTHHLPRFEPTSILQTLSKYPITVFCSAPTVYRMLVQNDITSYKFKSLKHCVSAGEPITPDVTEKWRNKTGLDIYEGYGQTETVLICGNFKGMKIKPGSMGKPSPAFDVKIVDVNGNVLPPGQEGDIGIQVLPNRPFGLFTHYVDNPSKTASTLRGNFYITGDRGYMDKDGYFWFVARADDVILSSGYRIGPFEVENALNEHPSVAESAVVSSPDPIRGEVVKAFVVLNPDYKSHDQEQLIKEIQEHVKKTTAPYKYPRKVEFIQELPKTISGKTKRNELRKKEWKTI

SEQ ID NO: 2022 - protein, 438 aa, Homo sapiens
  Payload ID: 512;
  Gene Symbol: ACSM3;
  Gene Name: acyl-CoA synthetase medium-chain family member 3;
  Uniprot ID:  Q53FZ2;
  ENSP ID: ENSP00000394565
MLARVTRKMLRHAKCFQRLAIFGSVRALHKDNRTATPQNFSNYESMKQDFKLGIPEYFNFAKDVLDQWTDKEKAGKKPSNPAFWWINRNGEEMRWSFEELGSLSRKFANILSEACSLQRGDRVILILPRVPEWWLANVACLRTGTVLIPGTTQLTQKDILYRLQSSKANCIITNDVLAPAVDAVASKCENLHSKLIVSENSREGWGNLKELMKHASDSHTCVKTKHNEIMAIFFTSGTSGYPKMTAHTHSSFGLGLSVNGRFWLDLTPSDVMWNTSDTGWAKSAWSSVFSPWIQGACVFTHHLPRFEPTSILQTLSKYPITVFCSAPTVYRMLVQNDITSYKFKSLKHCVSAGEPITPDVTEKWRNKTGLDIYEGYGQTETVLICGNFKGMKIKPGSMGKPSPAFDVKVCTSPSRRMFNNPICTLPTYRLPPYKLSLL

SEQ ID NO: 2023 - protein, 52 aa, Homo sapiens
  Payload ID: 512;
  Gene Symbol: ACSM3;
  Gene Name: acyl-CoA synthetase medium-chain family member 3;
  ENSP ID: ENSP00000456055
MLARVTRKMLRHAKCFQRLAIFGSVRALHKDNRTATPQNFSNYESMKQDFKL

SEQ ID NO: 2024 - protein, 582 aa, Homo sapiens
  Payload ID: 512;
  Gene Symbol: ACSM3;
  Gene Name: acyl-CoA synthetase medium-chain family member 3;
  ENSP ID: ENSP00000456767
  MOD_RES (1)..(1): Any amino acid
XYESMKQDFKLGIPEYFNFAKDVLDQWTDKEKAGKKPSNPAFWWINRNGEEMRWSFEELGSLSRKFANILSEACSLQRGDRVILILPRVPEWWLANVACLRTGTVLIPGTTQLTQKDILYRLQSSKANCIITNDVLAPAVDAVASKCENLHSKLIVSENSREGWGNLKELMKVFLCHPGWSTVARSWLTATSTSLVQAILSLLSSWDYRHASDSHTCVKTKHNEIMAIFFTSGTSGYPKMTAHTHSSFGLGLSVNGRFWLDLTPSDVMWNTSDTGWAKSAWSSVFSPWIQGACVFTHHLPRFEPTSILQTLSKYPITVFCSAPTVYRMLVQNDITSYKFKSLKHCVSAGEPITPDVTEKWRNKTGLDIYEGYGQTETVLICGNFKGMKIKPGSMGKPSPAFDVKIVDVNGNVLPPGQEGDIGIQVLPNRPFGLFTHYVDNPSKTASTLRGNFYITGDRGYMDKDGYFWFVARADDVILSSGYRIGPFEVENALNEHPSVAESAVVSSPDPIRGEVVKAFVVLNPDYKSHDQEQLIKEIQEHVKKTTAPYKYPRKVEFIQELPKTISGKTKRNELRKKEWKTI

SEQ ID NO: 2025 - protein, 100 aa, Homo sapiens
  Payload ID: 512;
  Gene Symbol: ACSM3;
  Gene Name: acyl-CoA synthetase medium-chain family member 3;
  ENSP ID: ENSP00000457003
MLARVTRKMLRHAKCFQRLAIFGSVRALHKDNRTATPQNFSNYESMKQDFKLGIPEYFNFAKDVLDQWTDKEKAGKKPSNPAFWWINRNGEEMRWSFEEL

SEQ ID NO: 2026 - protein, 25 aa, Homo sapiens
  Payload ID: 512;
  Gene Symbol: ACSM3;
  Gene Name: acyl-CoA synthetase medium-chain family member 3;
  ENSP ID: ENSP00000457158
MLARVTRKMLRHAKCFQRLAIFGSV

SEQ ID NO: 2027 - protein, 135 aa, Homo sapiens
  Payload ID: 512;
  Gene Symbol: ACSM3;
  Gene Name: acyl-CoA synthetase medium-chain family member 3;
  ENSP ID: ENSP00000457608
  MOD_RES (1)..(1): Any amino acid
XKWRNKTGLDIYEGYGQTETVLICGNFKGMKIKPGSMGKPSPAFDVKIVDVNGNVLPPGQEGDIGIQVLPNRPFGLFTHYVVVKAFVVLNPDYKSHDQEQLIKEIQEHVKKTTAPYKYPRKVEFIQELPKTISGK

SEQ ID NO: 2028 - protein, 235 aa, Homo sapiens
  Payload ID: 512;
  Gene Symbol: ACSM3;
  Gene Name: acyl-CoA synthetase medium-chain family member 3;
  ENSP ID: ENSP00000457926
  MOD_RES (1)..(1): Any amino acid
XSLLSSWDYRHASDSHTCVKTKHNEIMAIFFTSGTSGYPKMTAHTHSSFGLGLSVNGRFWLDLTPSDVMWNTSDTGWAKSAWSSVFSPWIQGACVFTHHLPRFEPTSILQTLSKYPITVFCSAPTVYRMLVQNDITSYKFKSLKHCVSAGEPITPDVTEKWRNKTGLDIYEGYGQTETVLICGNFKGMKIKPGSMGKPSPAFDVKVCTSPSRRMFNNPICTLPTYRLPPYKLSLL

SEQ ID NO: 2029 - protein, 158 aa, Homo sapiens
  Payload ID: 512;
  Gene Symbol: ACSM3;
  Gene Name: acyl-CoA synthetase medium-chain family member 3;
  ENSP ID: ENSP00000458068
MLARVTRKMLRHAKCFQRLAIFGSVRALHKDNRTATPQNFSNYESMKQDFKLGIPEYFNFAKDVLDQWTDKEKAGKKPSNPAFWWINRNGEEMRWSFEELGSLSRKFANILSEACSLQRGDRVILILPRVPEWWLANVACLRTGTVLIPGTTQLTQKD

SEQ ID NO: 2030 - protein, 580 aa, Homo sapiens
  Payload ID: 513;
  Gene Symbol: ACSM4;
  Gene Name: acyl-CoA synthetase medium-chain family member 4;
  Uniprot ID:  P0C7M7;
  ENSP ID: ENSP00000382349
MKIFFRYQTFRFIWLTKPPGRRLHKDHQLWTPLTLADFEAINRCNRPLPKNFNFAADVLDQWSQKEKTGERPANPALWWVNGKGDEVKWSFRELGSLSRKAANVLTKPCGLQRGDRLAVILPRIPEWWLVNVACIRTGIIFMPGTIQLTAKDILYRLRASKAKCIVASEEVAPAVESIVLECPDLKTKLLVSPQSWNGWLSFQELFQFASEEHSCVETGSQEPMTIYFTSGTTGFPKMAQHSQSSLGIGFTLCGRYWLDLKSSDIIWNMSDTGWVKAAIGSVFSSWLCGACVFVHRMAQFDTDTFLDTLTTYPITTLCSPPTVYRMLVQKDLKRYKFKSLRHCLTGGEPLNPEVLEQWRVQTGLELYEGYGQTEVGMICANQKGQEIKPGSMGKGMLPYDVQIIDENGNVLPPGKEGEIALRLKPTRPFCFFSKYVDNPQKTAATIRGDFYVTGDRGVMDSDGYFWFVGRADDVIISSGYRIGPFEVESALIEHPAVVESAVVSSPDQIRGEVVKAFVVLAAPFKSYNPEKLTLELQDHVKKSTAPYKYPRKVEFVQELPKTITGKIKRNVLRDQEWRGR

SEQ ID NO: 2031 - protein, 579 aa, Homo sapiens
  Payload ID: 514;
  Gene Symbol: ACSM5;
  Gene Name: acyl-CoA synthetase medium-chain family member 5;
  Uniprot ID:  Q6NUN0;
  ENSP ID: ENSP00000327916
MRPWLRHLVLQALRNSRAFCGSHGKPAPLPVPQKIVATWEAISLGRQLVPEYFNFAHDVLDVWSRLEEAGHRPPNPAFWWVNGTGAEIKWSFEELGKQSRKAANVLGGACGLQPGDRMMLVLPRLPEWWLVSVACMRTGTVMIPGVTQLTEKDLKYRLQASRAKSIITSDSLAPRVDAISAECPSLQTKLLVSDSSRPGWLNFRELLREASTEHNCMRTKSRDPLAIYFTSGTTGAPKMVEHSQSSYGLGFVASGRRWVALTESDIFWNTTDTGWVKAAWTLFSAWPNGSCIFVHELPRVDAKVILNTLSKFPITTLCCVPTIFRLLVQEDLTRYQFQSLRHCLTGGEALNPDVREKWKHQTGVELYEGYGQSETVVICANPKGMKIKSGSMGKASPPYDVQIVDDEGNVLPPGEEGNVAVRIRPTRPFCFFNCYLDNPEKTAASEQGDFYITGDRARMDKDGYFWFMGRNDDVINSSSYRIGPVEVESALAEHPAVLESAVVSSPDPIRGEVVKAFIVLTPAYSSHDPEALTRELQEHVKRVTAPYKYPRKVAFVSELPKTVSGKIQRSKLRSQEWGK

SEQ ID NO: 2032 - protein, 208 aa, Homo sapiens
  Payload ID: 514;
  Gene Symbol: ACSM5;
  Gene Name: acyl-CoA synthetase medium-chain family member 5;
  Uniprot ID:  Q6NUN0;
  ENSP ID: ENSP00000460112
MRPWLRHLVLQALRNSRAFCGSHGKPAPLPVPQKIVATWEAISLGRQLVPEYFNFAHDVLDVWSRLEEAGHRPPNPAFWWVNGTGAEIKWSFEELGKQSRKAANVLGGACGLQPGDRMMLVLPRLPEWWLVSVACMRTGTVMIPGVTQLTEKDLKYRLQASRAKSIITSDSLAPRVDAISAECPSLQTKLLVSDSSRPGWLNFRELLR

SEQ ID NO: 2033 - protein, 112 aa, Homo sapiens
  Payload ID: 514;
  Gene Symbol: ACSM5;
  Gene Name: acyl-CoA synthetase medium-chain family member 5;
  ENSP ID: ENSP00000461752
HNCMRTKSRDPLAIYFTSGTTGAPKMVEHSQSSYGLGFVASGRRWVALTESDIFWNTTDTGWVKAAWTLFSAWPNGSCIFVHELPRVDAKVILNVPVSEPEALSDRRRGPQP

SEQ ID NO: 2034 - protein, 74 aa, Homo sapiens
  Payload ID: 514;
  Gene Symbol: ACSM5;
  Gene Name: acyl-CoA synthetase medium-chain family member 5;
  ENSP ID: ENSP00000478073
MRPWLRHLVLQALRNSRAFCGSHGKPAPLPVPQKIVATWEAISLGRQLVPEYFNFAHDVLDVWSRLEEVKPVLS

SEQ ID NO: 2035 - protein, 141 aa, Homo sapiens
  Payload ID: 515;
  Gene Symbol: ACSM6;
  Gene Name: acyl-CoA synthetase medium-chain family member 6;
  ENSP ID: ENSP00000328491
MLGRFQPFSLVRSFRLGFEACCYPNQKCATQTIRPPDSRCLVQAVSQNFNFAKDVLDQWSQLEKDGLRGPYPALWKVSAKGEEDKWSFERMTQLSKKAASILSDTCALSHGDRLMIILPPTPEAYWICLACESPLCLGAPS

SEQ ID NO: 2036 - protein, 480 aa, Homo sapiens
  Payload ID: 515;
  Gene Symbol: ACSM6;
  Gene Name: acyl-CoA synthetase medium-chain family member 6;
  Uniprot ID:  Q6P461;
  ENSP ID: ENSP00000340296
MLGRFQPFSLVRSFRLGFEACCYPNQKCATQTIRPPDSRCLVQAVSQNFNFAKDVLDQWSQLEKDGLRGPYPALWKVSAKGEEDKWSFERMTQLSKKAASILSDTCALSHGDRLMIILPPTPEAYWICLACVRLGITFVPGSPQLTAKKIRYQLRMSKAQCIVANEAMAPVVNSAVSDCPTLKTKLLVSDKSYDGWLDFKKLIQVAPPKQTYMRTKSQDPMAIFFTKGTTGAPKMVEYSQYGLGMGFSQASRRWMDLQPTDVLWSLGDAFGGSLSLSAVLGTWFQGACVFLCHMPTFCPETVLNVLSRFPITTLSANPEMYQELLQHKCFTSYRFKSLKQCVAAGGPISPGVIEDWKRITKLDIYEGYGQTETGLLCATSKTIKLKPSSLGKPLPPYIVQIVDENSNLLPPGEEGNIAIRIKLNQPASLYCPHMVSWEEYASARGHMLYLTGDRGIMDEDGYFWWSGRVDDVANALGQRL

SEQ ID NO: 2037 - protein, 480 aa, Homo sapiens; identical to SEQ ID NO: 2036
  Payload ID: 515;
  Gene Symbol: ACSM6;
  Gene Name: acyl-CoA synthetase medium-chain family member 6;
  Uniprot ID:  Q6P461;
  ENSP ID: ENSP00000377573

SEQ ID NO: 2038 - protein, 85 aa, Homo sapiens
  Payload ID: 515;
  Gene Symbol: ACSM6;
  Gene Name: acyl-CoA synthetase medium-chain family member 6;
  ENSP ID: ENSP00000384922
MLGRFQPFSLVRSFRLGFEACCYPNQKCATQTIRPPDSRCLVQAVSQNFNFAKDVLDQWSQLEKDNGLQLHPCCCKRQDFILFHG

SEQ ID NO: 2039 - protein, 689 aa, Homo sapiens [sequence omitted]

SEQ ID NO: 2040 - protein, 153 aa, Homo sapiens
  Payload ID: 516;
  Gene Symbol: ACSS1;
  Gene Name: acyl-CoA synthetase short-chain family member 1;
  ENSP ID: ENSP00000365916
MAARTLGRGVGRLLGSLRGLSGQPARPPCGVSAPRRAASGPSGSAPAVAAAAAQPGSYPALSAQAAREPAAFWGPLARDTLVWDTPYHTVWDCDFSTGKIGWFLGGQLNVSVNCLDQHVRKSPESVALIWERDEPGTEVRITYSPWLQMPCGP

SEQ ID NO: 2041 - protein, 575 aa, Homo sapiens
  Payload ID: 516;
  Gene Symbol: ACSS1;
  Gene Name: acyl-CoA synthetase short-chain family member 1;
  Uniprot ID:  Q9NUB1;
  ENSP ID: ENSP00000388793
MAARTLGRGVGRLLGSLRGLSGQPARPPCGVSAPRRAASGPSGSAPAVAAAAAQPGSYPALSAQAAREPAAFWGPLARDTLVWDTPYHTVWDCDFSTGKIGWFLGGQLNVSVNCLDQHVRKSPESVALIWERDEPGTEVRITYRELLETTCRLANTLKRHGVHRGDRVAIYMPVSPLAVAAMLACARIGAVHTVIFAGFSAESLAGRINDAKCKVVITFNQGLRGGRVVELKKIVDEAVKHCPTVQHVLVAHRTDNKVHMGDLDVPLEQEMAKEDPVCAPESMGSEDMLFMLYTSGSTGMPKGIVHTQAGYLLYAALTHKLVFDHQPGDIFGCVADIGWITGHSYVVYGPLCNGATSVLFESTPVYPNAGRYWETVERLKINQFYGAPTAVRLLLKYGDAWVKKYDRSSLRTLGSVGEPINCEAWEWLHRVVGDSRCTLVDTWWQTETGGICIAPRPSEEGAEILPAMAMRPFFGIVPVLMDEKGSVVEGSNVSGALCISQAWPGMARTIYGDHQRFVDAYFKAYPGYYFTGDGAYRTEGGYYQITGRMDDVINILQIVGFFREAIRNSGDLLEH

SEQ ID NO: 2042 - protein, 568 aa, Homo sapiens
  Payload ID: 516;
  Gene Symbol: ACSS1;
  Gene Name: acyl-CoA synthetase short-chain family member 1;
  Uniprot ID:  Q9NUB1;
  ENSP ID: ENSP00000439304
MRRRKERQPWDRFHFLHFAPHGRELLETTCRLANTLKRHGVHRGDRVAIYMPVSPLAVAAMLACARIGAVHTVIFAGFSAESLAGRINDAKCKVVITFNQGLRGGRVVELKKIVDEAVKHCPTVQHVLVAHRTDNKVHMGDLDVPLEQEMAKEDPVCAPESMGSEDMLFMLYTSGSTGMPKGIVHTQAGYLLYAALTHKLVFDHQPGDIFGCVADIGWITGHSYVVYGPLCNGATSVLFESTPVYPNAGRYWETVERLKINQFYGAPTAVRLLLKYGDAWVKKYDRSSLRTLGSVGEPINCEAWEWLHRVVGDSRCTLVDTWWQTETGGICIAPRPSEEGAEILPAMAMRPFFGIVPVLMDEKGSVVEGSNVSGALCISQAWPGMARTIYGDHQRFVDAYFKAYPGYYFTGDGAYRTEGGYYQITGRMDDVINISGHRLGTAEIEDAIADHPAVPESAVIGYPHDIKGEAAFAFIVVKDSAGDSDVVVQELKSMVATKIAKYAVPDEILVVKRLPKTRSGKVMRRLLRKIITSEAQELGDTTTLEDPSIIAEILSVYQKCKDKQAAAK

SEQ ID NO: 2043 - protein, 714 aa, Homo sapiens
  Payload ID: 517;
  Gene Symbol: ACSS2;
  Gene Name: acyl-CoA synthetase short-chain family member 2;
  Uniprot ID:  Q9NR19;
  ENSP ID: ENSP00000253382
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEKGFPVRCCIVVKHLGRAELGMGDSTSQSPPIKRSCPDVQGKLKEKSKRVQPQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 2044 - protein, 701 aa, Homo sapiens [sequence omitted]

SEQ ID NO: 2045 - protein, 163 aa, Homo sapiens
  Payload ID: 517;
  Gene Symbol: ACSS2;
  Gene Name: acyl-CoA synthetase short-chain family member 2;
  ENSP ID: ENSP00000417783
MMVRWALLCEFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLIT

SEQ ID NO: 2046 - protein, 37 aa, Homo sapiens
  Payload ID: 517;
  Gene Symbol: ACSS2;
  Gene Name: acyl-CoA synthetase short-chain family member 2;
  ENSP ID: ENSP00000418152
MMVRWALLCGECRILGRHCQGILLEDSMPWPIPSVQL

SEQ ID NO: 2047 - protein, 124 aa, Homo sapiens
  Payload ID: 517;
  Gene Symbol: ACSS2;
  Gene Name: acyl-CoA synthetase short-chain family member 2;
  ENSP ID: ENSP00000418362
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFY

SEQ ID NO: 2048 - protein, 60 aa, Homo sapiens
  Payload ID: 517;
  Gene Symbol: ACSS2;
  Gene Name: acyl-CoA synthetase short-chain family member 2;
  ENSP ID: ENSP00000418608
MGLPEERVRSGSGSRGQEEAGAGGRARSWSPPPENSGETLPRNFTGRLHALAHSFGTTLM

SEQ ID NO: 2049 - protein, 182 aa, Homo sapiens
  Payload ID: 517;
  Gene Symbol: ACSS2;
  Gene Name: acyl-CoA synthetase short-chain family member 2;
  ENSP ID: ENSP00000418812
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYCGDVVLPCWPGWSQLPDLREGNEPGETTQITYHQLLVQVCQFSNVLRKQGIQKGDRVA

SEQ ID NO: 2050 - protein, 147 aa, Homo sapiens
  Payload ID: 517;
  Gene Symbol: ACSS2;
  Gene Name: acyl-CoA synthetase short-chain family member 2;
  ENSP ID: ENSP00000419167
MGLPEERVRSGSGSRGQEEAGAGGRARSWSPPPEVSRSAHVPSLQRYRELHRRSVEEPREFYWKTPCPGPFLRYNFDVTKGKIFIEWMKGATTNICYNVLDRNVHEKKLGDKVAFYWEGNEPGETTQITYHQLLVQVCQFSNVLRKQ

SEQ ID NO: 2051 - protein, 203 aa, Homo sapiens
  Payload ID: 517;
  Gene Symbol: ACSS2;
  Gene Name: acyl-CoA synthetase short-chain family member 2;
  ENSP ID: ENSP00000419925
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWSTSGNSSYRYTCREGNEPGETTQITYHQLLVQVCQFSNVLRKQGIQKGDRVAIYMPMIPELVVAMLACARIGALHSIV

SEQ ID NO: 2052 - protein, 74 aa, Homo sapiens
  Payload ID: 517;
  Gene Symbol: ACSS2;
  Gene Name: acyl-CoA synthetase short-chain family member 2;
  ENSP ID: ENSP00000420105
MMVRWALLCEFWGDIAKEFYWKTPCPGPFLRYNFDVTKGKIFIEWMKGATTNICYNVLDRNVHEKKLGDKVAFY

SEQ ID NO: 2053 - protein, 187 aa, Homo sapiens
  Payload ID: 517;
  Gene Symbol: ACSS2;
  Gene Name: acyl-CoA synthetase short-chain family member 2;
  ENSP ID: ENSP00000420351
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWCSSSPGQGSCAQSMGTTNALRQPTLRSFLDTMLQEMAASGTRMAITGSLAGLMTCSMYLDTC

SEQ ID NO: 2054 - protein, 685 aa, Homo sapiens
  Payload ID: 518;
  Gene Symbol: ACSS3;
  Gene Name: acyl-CoA synthetase short-chain family member 3;
  ENSP ID: ENSP00000261206
MKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 2055 - protein, 93 aa, Homo sapiens
  Payload ID: 518;
  Gene Symbol: ACSS3;
  Gene Name: acyl-CoA synthetase short-chain family member 3;
  ENSP ID: ENSP00000447748
MLNICYNAVDRHIENGKGDKIAIIYDSPVTNTKATFTYKEVLEQVSKLAGVLVKHGIKKGDTVVIYMPMIPQAMYTMLACARIGAIHSLIFGG

SEQ ID NO: 2056 - protein, 75 aa, Homo sapiens
  Payload ID: 518;
  Gene Symbol: ACSS3;
  Gene Name: acyl-CoA synthetase short-chain family member 3;
  ENSP ID: ENSP00000449507
  MOD_RES (1)..(1): Any amino acid
XLAEHGVAALFTAPTAIRAIRQQDPGAALGKQYSLTRFKTLFVAGERCDVETLEWSKNVFRVPVLDHWWQTGIKH

SEQ ID NO: 2057 - protein, 686 aa, Homo sapiens
  Payload ID: 518;
  Gene Symbol: ACSS3;
  Gene Name: acyl-CoA synthetase short-chain family member 3;
  Uniprot ID:  Q9H6R3;
  ENSP ID: ENSP00000449535
MKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRWFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 2058 - protein, 421 aa, Homo sapiens
  Payload ID: 519;
  Gene Symbol: ACOT1;
  Gene Name: acyl-CoA thioesterase 1;
  Uniprot ID:  Q86TX2;
  ENSP ID: ENSP00000311224
MAATLILEPAGRCCWDEPVRIAVRGLAPEQPVTLRASLRDEKGALFQAHARYRADTLGELDLERAPALGGSFAGLEPMGLLWALEPEKPLVRLVKRDVRTPLAVELEVLDGHDPDPGRLLCRVRHERYFLPPGVRREPVRAGRVRGTLFLPPEPGPFPGIVDMFGTGGGLLEYRASLLAGKGFAVMALAYYNYEDLPKTMETLHLEYFEEAVNYLLSHPEVKGPGVGLLGISKGGELCLSMASFLKGITAAVVINGSVANVGGTLRYKGETLPPVGVNRNRIKVTKDGYADIVDVLNSPLEGPDQKSFIPVERAESTFLFLVGQDDHNWKSEFYANEACKRLQAHGRRKPQIICYPETGHYIEPPYFPLCRASLHALVGSPIIWGGEPRAHAMAQVDAWKQLQTFFHKHLGGHEGTIPSKV

SEQ ID NO: 2059 - protein, 395 aa, Homo sapiens
  Payload ID: 519;
  Gene Symbol: ACOT1;
  Gene Name: acyl-CoA thioesterase 1;
  ENSP ID: ENSP00000451764
MAATLILEPAGRCCWDEPVRIAVRGLAPEQPVTLRASLRDEKGALFQAHARYRADTLGELDLERAPALGGSFAGLEPMGLLWALEPEKPLVRLVKRDVRTPLAVELEVLDGHDPDPGRLLCRVRHERYFLPPGVRREPVRAGRVRGTLFLPPEPGPFPGIVDMFGTGGGLLEYRASLLAGKGFAVMALAYYNYEDLPKTMETLHLEYFEEAVNYLLSHPEGITAAVVINGSVANVGGTLRYKGETLPPVGVNRNRIKVTKDGYADIVDVLNSPLEGPDQKSFIPVERAESTFLFLVGQDDHNWKSEFYANEACKRLQAHGRRKPQIICYPETGHYIEPPYFPLCRASLHALVGSPIIWGGEPRAHAMAQVDAWKQLQTFFHKHLGGHEGTIPSKV

SEQ ID NO: 2060 - protein, 594 aa, Homo sapiens
  Payload ID: 520;
  Gene Symbol: ACOT11;
  Gene Name: acyl-CoA thioesterase 11;
  Uniprot ID:  Q8WXI4;
  ENSP ID: ENSP00000340260
MIQNVGNHLRRGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKVSYYNQATPGVLNYVTTNVAGLSSEFYTTFKACEQFLLDNRNDLAPSLQTL

SEQ ID NO: 2061 - protein, 607 aa, Homo sapiens
  Payload ID: 520;
  Gene Symbol: ACOT11;
  Gene Name: acyl-CoA thioesterase 11;
  Uniprot ID:  Q8WXI4;
  ENSP ID: ENSP00000360366
MIQNVGNHLRRGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKCCWVRVSLTELVSASGFYSWGLESRSKGRRSDGWNGKLAGGHLSTLKAIPVAKINSRFGYLQDT

SEQ ID NO: 2062 - protein, 555 aa, Homo sapiens
  Payload ID: 521;
  Gene Symbol: ACOT12;
  Gene Name: acyl-CoA thioesterase 12;
  Uniprot ID:  Q8WYK0;
  ENSP ID: ENSP00000303246
MERPAPGEVVMSQAIQPAHATARGELSAGQLLKWIDTTACLAAEKHAGVSCVTASVDDIQFEETARVGQVITIKAKVTRAFSTSMEISIKVMVQDMLTGIEKLVSVAFSTFVAKPVGKEKIHLKPVTLLTEQDHVEHNLAAERRKVRLQHEDTFNNLMKESSKFDDLIFDEEEGAVSTRGTSVQSIELVLPPHANHHGNTFGGQIMAWMETVATISASRLCWAHPFLKSVDMFKFRGPSTVGDRLVFTAIVNNTFQTCVEVGVRVEAFDCQEWAEGRGRHINSAFLIYNAADDKENLITFPRIQPISKDDFRRYRGAIARKRIRLGRKYVISHKEEVPLCIHWDISKQASLSDSNVEALKKLAAKRGWEVTSTVEKIKIYTLEEHDVLSVWVEKHVGSPAHLAYRLLSDFTKRPLWDPHFVSCEVIDWVSEDDQLYHITCPILNDDKPKDLVVLVSRRKPLKDGNTYTVAVKSVILPSVPPSPQYIRSEIICAGFLIHAIDSNSCIVSYFNHMSASILPYFAGNLGGWSKSIEETAASCIQFLENPPDDGFVSTF

SEQ ID NO: 2063 - protein, 167 aa, Homo sapiens
  Payload ID: 521;
  Gene Symbol: ACOT12;
  Gene Name: acyl-CoA thioesterase 12;
  Uniprot ID:  Q8WYK0;
  ENSP ID: ENSP00000421628
MERPAPGEVVMSQAIQPAHATARGELSAGQLLKWIDTTACLAAEKHAGVSCVTASVDDIQFEETARVGQVITIKAKVTRAFSTSMEISIKVMVQDMLTGIEKLVSVAFSTFVAKPVGKEKIHLKPVTLLTEQDHVEHNLAAERRKVRLQHEDTFNNLMKESSKFDGQ

SEQ ID NO: 2064 - protein, 140 aa, Homo sapiens
  Payload ID: 522;
  Gene Symbol: ACOT13;
  Gene Name: acyl-CoA thioesterase 13;
  Uniprot ID:  Q9NPJ3;
  ENSP ID: ENSP00000230048
MTSMTQSLREVIKAMTKARNFERVLGKITLVSAAPGKVICEMKVEEEHTNAIGTLHGGLTATLVDNISTMALLCTERGAPGVSVDMNITYMSPAKLGEDIVITAHVLKQGKTLAFTSVDLTNKATGKLIAQGRHTKHLGN

SEQ ID NO: 2065 - protein, 117 aa, Homo sapiens
  Payload ID: 522;
  Gene Symbol: ACOT13;
  Gene Name: acyl-CoA thioesterase 13;
  Uniprot ID:  Q9NPJ3;
  ENSP ID: ENSP00000445552
MVRKITLVSAAPGKVICEMKVEEEHTNAIGTLHGGLTATLVDNISTMALLCTERGAPGVSVDMNITYMSPAKLGEDIVITAHVLKQGKTLAFTSVDLTNKATGKLIAQGRHTKHLGN

SEQ ID NO: 2066 - protein, 483 aa, Homo sapiens
  Payload ID: 523;
  Gene Symbol: ACOT2;
  Gene Name: acyl-CoA thioesterase 2;
  Uniprot ID:  P49753;
  ENSP ID: ENSP00000238651
MSNKLLSPHPHSVVLRSEFKMASSPAVLRASRLYQWSLKSSAQFLGSPQLRQVGQIIRVPARMAATLILEPAGRCCWDEPVRIAVRGLAPEQPVTLRASLRDEKGALFQAHARYRADTLGELDLERAPALGGSFAGLEPMGLLWALEPEKPLVRLVKRDVRTPLAVELEVLDGHDPDPGRLLCQTRHERYFLPPGVRREPVRVGRVRGTLFLPPEPGPFPGIVDMFGTGGGLLEYRASLLAGKGFAVMALAYYNYEDLPKTMETLHLEYFEEAMNYLLSHPEVKGPGVGLLGISKGGELCLSMASFLKGITAAVVINGSVANVGGTLHYKGETLPPVGVNRNRIKVTKDGYADIVDVLNSPLEGPDQKSFIPVERAESTFLFLVGQDDHNWKSEFYANEACKRLQAHGRRKPQIICYPETGHYIEPPYFPLCRASLHALVGSPIIWGGEPRAHAMAQVDAWKQLQTFFHKHLGGHEGTIPSKV

SEQ ID NO: 2067 - protein, 64 aa, Homo sapiens
  Payload ID: 523;
  Gene Symbol: ACOT2;
  Gene Name: acyl-CoA thioesterase 2;
  ENSP ID: ENSP00000440961
MASSPAVLRASRLYQWSLKSSAQFLGSPQLRQNLGPFLGLWTCSELEVACWSIGLVCWLGRVLL

SEQ ID NO: 2068 - protein, 463 aa, Homo sapiens
  Payload ID: 523;
  Gene Symbol: ACOT2;
  Gene Name: acyl-CoA thioesterase 2;
  ENSP ID: ENSP00000477685
MASSPAVLRASRLYQWSLKSSAQFLGSPQLRQVGQIIRVPARMAATLILEPAGRCCWDEPVRIAVRGLAPEQPVTLRASLRDEKGALFQAHARYRADTLGELDLERAPALGGSFAGLEPMGLLWALEPEKPLVRLVKRDVRTPLAVELEVLDGHDPDPGRLLCQTRHERYFLPPGVRREPVRVGRVRGTLFLPPEPGPFPGIVDMFGTGGGLLEYRASLLAGKGFAVMALAYYNYEDLPKTMETLHLEYFEEAMNYLLSHPEVKGPGVGLLGISKGGELCLSMASFLKGITAAVVINGSVANVGGTLHYKGETLPPVGVNRNRIKVTKDGYADIVDVLNSPLEGPDQKSFIPVERAESTFLFLVGQDDHNWKSEFYANEACKRLQAHGRRKPQIICYPETGHYIEPPYFPLCRASLHALVGSPIIWGGEPRAHAMAQVDAWKQLQTFFHKHLGGHEGTIPSKV

SEQ ID NO: 2069 - protein, 421 aa, Homo sapiens [sequence omitted]

SEQ ID NO: 2070 - protein, 421 aa, Homo sapiens
  Payload ID: 524;
  Gene Symbol: ACOT4;
  Gene Name: acyl-CoA thioesterase 4;
  Uniprot ID:  Q8N9L9;
  ENSP ID: ENSP00000323071
MSATLILEPPGRCCWNEPVRIAVRGLAPEQRVTLRASLRDEKGALFRAHARYCADARGELDLERAPALGGSFAGLEPMGLLWALEPEKPFWRFLKRDVQIPFVVELEVLDGHDPEPGRLLCQAQHERHFLPPGVRRQSVRAGRVRATLFLPPGPGPFPGIIDIFGIGGGLLEYRASLLAGHGFATLALAYYNFEDLPNNMDNISLEYFEEAVCYMLQHPQVKGPGIGLLGISLGADICLSMASFLKNVSATVSINGSGISGNTAINYKHSSIPPLGYDLRRIKVAFSGLVDIVDIRNALVGGYKNPSMIPIEKAQGPILLIVGQDDHNWRSELYAQTVSERLQAHGKEKPQIICYPGTGHYIEPPYFPLCPASLHRLLNKHVIWGGEPRAHSKAQEDAWKQILAFFCKHLGGTQKTAVPKL

SEQ ID NO: 2071 - protein, 207 aa, Homo sapiens
  Payload ID: 525;
  Gene Symbol: ACOT6;
  Gene Name: acyl-CoA thioesterase 6;
  Uniprot ID:  Q3I5F7;
  ENSP ID: ENSP00000370531
MLQHPKVKGPSIALLGFSKGGDLCLSMASFLKGITATVLINACVANTVAPLHYKDMIIPKLVDDLGKVKITKSGFLTFMDTWSNPLEEHNHQSLVPLEKAQVPFLFIVGMDDQSWKSEFYAQIASERLQAHGKERPQIICYPETGHCIDPPYFPPSRASVHAVLGEAIFYGGEPKAHSKAQVDAWQQIQTFFHKHLNGKKSVKHSKI

SEQ ID NO: 2072 - protein, 168 aa, Homo sapiens
  Payload ID: 525;
  Gene Symbol: ACOT6;
  Gene Name: acyl-CoA thioesterase 6;
  ENSP ID: ENSP00000451464
MLQHPKVKGPSIALLGFSKGGDLCLSMASFLKGITATVLINACVANTVAPLHYKDMIIPKLVDDLGKVKITKSGFLTFMDTWSNPLEEHNHQSLVPLEKAQVPFLFIVGMDDQSWKSEFYAQIASERLQAHGKERPQIICYPETGHCIDPPYFPPSRASVHAVLGEAI

SEQ ID NO: 2073 - protein, 370 aa, Homo sapiens
  Payload ID: 526;
  Gene Symbol: ACOT7;
  Gene Name: acyl-CoA thioesterase 7;
  Uniprot ID:  O00154;
  ENSP ID: ENSP00000354615
MARPGLIHSAPGLPDTCALLQPPAASAAAAPSMSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 2074 - protein, 329 aa, Homo sapiens
  Payload ID: 526;
  Gene Symbol: ACOT7;
  Gene Name: acyl-CoA thioesterase 7;
  Uniprot ID:  O00154;
  ENSP ID: ENSP00000367073
MAFQLSRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 2075 - protein, 350 aa, Homo sapiens
  Payload ID: 526;
  Gene Symbol: ACOT7;
  Gene Name: acyl-CoA thioesterase 7;
  Uniprot ID:  O00154;
  ENSP ID: ENSP00000367076
MLLLRRSLSLNVLRKEVDRACFGEKAKQIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 2076 - protein, 380 aa, Homo sapiens
  Payload ID: 526;
  Gene Symbol: ACOT7;
  Gene Name: acyl-CoA thioesterase 7;
  Uniprot ID:  O00154;
  ENSP ID: ENSP00000367086
MKLLARALRLCEFGRQASSRRLVAGQGCVGPRRGCCAPVQVVGPRADLPPCGACITGRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 2077 - protein, 283 aa, Homo sapiens
  Payload ID: 526;
  Gene Symbol: ACOT7;
  Gene Name: acyl-CoA thioesterase 7;
  Uniprot ID:  O00154;
  ENSP ID: ENSP00000367091
MSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKAHVMPAGADHTAPSSSPSTGTKCSLLRHHHLGTHDLHEQ

SEQ ID NO: 2078 - protein, 246 aa, Homo sapiens
  Payload ID: 526;
  Gene Symbol: ACOT7;
  Gene Name: acyl-CoA thioesterase 7;
  Uniprot ID:  O00154;
  ENSP ID: ENSP00000402532
MSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKAP

SEQ ID NO: 2079 - protein, 370 aa, Homo sapiens; identical to SEQ ID NO: 2073
  Payload ID: 526;
  Gene Symbol: ACOT7;
  Gene Name: acyl-CoA thioesterase 7;
  Uniprot ID:  O00154;
  ENSP ID: ENSP00000439218

SEQ ID NO: 2080 - protein, 279 aa, Homo sapiens
  Payload ID: 526;
  Gene Symbol: ACOT7;
  Gene Name: acyl-CoA thioesterase 7;
  ENSP ID: ENSP00000465719
MRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQE

SEQ ID NO: 2081 - protein, 338 aa, Homo sapiens
  Payload ID: 526;
  Gene Symbol: ACOT7;
  Gene Name: acyl-CoA thioesterase 7;
  Uniprot ID:  O00154;
  ENSP ID: ENSP00000476610
MSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 2082 - protein, 319 aa, Homo sapiens
  Payload ID: 527;
  Gene Symbol: ACOT8;
  Gene Name: acyl-CoA thioesterase 8;
  Uniprot ID:  O14734;
  ENSP ID: ENSP00000217455
MSSPQAPEDGQGCGDRGDPPGDLRSVLVTTVLNLEPLDEDLFRGRHYWVPAKRLFGGQIVGQALVAAAKSVSEDVHVHSLHCYFVRAGDPKLPVLYQVERTRTGSSFSVRSVKAVQHGKPIFICQASFQQAQPSPMQHQFSMPTVPPPEELLDCETLIDQYLRDPNLQKRYPLALNRIAAQEVPIEIKPVNPSPLSQLQRMEPKQMFWVRARGYIGEGDMKMHCCVAAYISDYAFLGTALLPHQWQHKVHFMVSLDHSMWFHAPFRADHWMLYECESPWAGGSRGLVHGRLWRQDGVLAVTCAQEGVIRVKPQVSESKL

SEQ ID NO: 2083 - protein, 74 aa, Homo sapiens
  Payload ID: 527;
  Gene Symbol: ACOT8;
  Gene Name: acyl-CoA thioesterase 8;
  ENSP ID: ENSP00000403862
  MOD_RES (1)..(1): Any amino acid
XLFRGRHYWVPAKRLFGGQIVGQALVAAAKSVSEDVHVHSLHCYFVRAEQMPSCVLRRSPAEKSLWTFTVCDLY

SEQ ID NO: 2084 - protein, 92 aa, Homo sapiens
  Payload ID: 527;
  Gene Symbol: ACOT8;
  Gene Name: acyl-CoA thioesterase 8;
  ENSP ID: ENSP00000416217
SPQAPEDGQGCGDRGDPPGDLRSVLVTTVLNLEPLDEDLFRGRHYWVPAKRLFGGQIVGQALVAAAKSVSEDVHVHSLHCYFVRADALMCSA

SEQ ID NO: 2085 - protein, 209 aa, Homo sapiens [sequence omitted]

SEQ ID NO: 2086 - protein, 94 aa, Homo sapiens
  Payload ID: 527;
  Gene Symbol: ACOT8;
  Gene Name: acyl-CoA thioesterase 8;
  ENSP ID: ENSP00000431175
MSSPQAPEDGQGCGDRGDPPGDLRSVLVTTVLNLEPLDEDLFRGRHYWVPAKRLFGGQIVGQALVAAAKSVSEDVHVHSLHCYFVRADALMCSA

SEQ ID NO: 2087 - protein, 132 aa, Homo sapiens
  Payload ID: 527;
  Gene Symbol: ACOT8;
  Gene Name: acyl-CoA thioesterase 8;
  ENSP ID: ENSP00000433923
MSSPQAPEDGQGCGDRGDPPGDLRSVLVTTVLNLEPLDEDLFRGRHYWVPAKRLFGGQIVGQALVAAAKSVSEDVHVHSLHCYFVRAEQMPSCVLRRSPAEKSLWTFTGTRSCQYCTKWSGHEQGRASRCAL

SEQ ID NO: 2088 - protein, 171 aa, Homo sapiens
  Payload ID: 527;
  Gene Symbol: ACOT8;
  Gene Name: acyl-CoA thioesterase 8;
  ENSP ID: ENSP00000434216
MSSPQAPEDGQGCGDRGDPPGDLRSVLVTTVLNLEPLDEDLFRDPNLQKRYPLALNRIAAQEVPIEIKPVNPSPLSQLQRMEPKQMFWVRARGYIGEGDMKMHCCVAAYISDYAFLGTALLPHQWQHKVHFMVSLDHSMWFHAPFRADHWMLYECESPWAGFGIFIFKMRG

SEQ ID NO: 2089 - protein, 107 aa, Homo sapiens
  Payload ID: 527;
  Gene Symbol: ACOT8;
  Gene Name: acyl-CoA thioesterase 8;
  ENSP ID: ENSP00000435115
MSSPQAPEDGQGCGDRGDPPGDLRSVLVTTVLNLEPLDEDLFRGPEAASTVPSGADTNRVELLGALCEGRATWEAHLHLPGLLPAGPAQPHAAPVLHAHCATTRRAA

SEQ ID NO: 2090 - protein, 226 aa, Homo sapiens
  Payload ID: 527;
  Gene Symbol: ACOT8;
  Gene Name: acyl-CoA thioesterase 8;
  ENSP ID: ENSP00000435581
MSSPQAPEDGQGCGDRGDPPGDLRSVLVTTVLNLEPLDEDLFRGRHYWVPAKRLFGGQIVGQALVAAAKSVSEDVHVHSLHCYFVRAGDPKLPVLYQVERTRTGSSFSVRSVKAVQHGKPIFICQASFQQAQPSPMQHQFSMPTVPPPEELLDCETLIDQYLRDPNLQKRYPLALNRIAAQEVPIEIKPVNPSPLSQLQRMEPKQMFWVRARGYIGPELESPGAQG

SEQ ID NO: 2091 - protein, 439 aa, Homo sapiens
  Payload ID: 528;
  Gene Symbol: ACOT9;
  Gene Name: acyl-CoA thioesterase 9;
  Uniprot ID:  Q9Y305;
  ENSP ID: ENSP00000336580
MRRAALRLCALGKGQLTPGRGLTQGPQNPKKQGIFHIHEVRDKLREIVGASTNWRDHVKAMEERKLLHSFLAKSQDGLPPRRMKDSYIEVLLPLGSEPELREKYLTVQNTVRFGRILEDLDSLGVLICYMHNKIHSAKMSPLSIVTALVDKIDMCKKSLSPEQDIKFSGHVSWVGKTSMEVKMQMFQLHGDEFCPVLDATFVMVARDSENKGPAFVNPLIPESPEEEELFRQGELNKGRRIAFSSTSLLKMAPSAEERTTIHEMFLSTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 2092 - protein, 379 aa, Homo sapiens
  Payload ID: 528;
  Gene Symbol: ACOT9;
  Gene Name: acyl-CoA thioesterase 9;
  Uniprot ID:  Q9Y305;
  ENSP ID: ENSP00000368597
MEERKLLHSFLAKSQDGLPPRRMKDSYIEVLLPLGSEPELREKYLTVQNTVRFGRILEDLDSLGVLICYMHNKIHSAKMSPLSIVTALVDKIDMCKKSLSPEQDIKFSGHVSWVGKTSMEVKMQMFQLHGDEFCPVLDATFVMVARDSENKGPAFVNPLIPESPEEEELFRQGELNKGRRIAFSSTSLLKMAPSAEERTTIHEMFLSTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 2093 - protein, 448 aa, Homo sapiens
  Payload ID: 528;
  Gene Symbol: ACOT9;
  Gene Name: acyl-CoA thioesterase 9;
  Uniprot ID:  Q9Y305;
  ENSP ID: ENSP00000368605
MRRAALRLCALGKGQLTPGRGLTQGPQNPKKQGIFHIHEACSSIHVNHVRDKLREIVGASTNWRDHVKAMEERKLLHSFLAKSQDGLPPRRMKDSYIEVLLPLGSEPELREKYLTVQNTVRFGRILEDLDSLGVLICYMHNKIHSAKMSPLSIVTALVDKIDMCKKSLSPEQDIKFSGHVSWVGKTSMEVKMQMFQLHGDEFCPVLDATFVMVARDSENKGPAFVNPLIPESPEEEELFRQGELNKGRRIAFSSTSLLKMAPSAEERTTIHEMFLSTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 2094 - protein, 136 aa, Homo sapiens
  Payload ID: 528;
  Gene Symbol: ACOT9;
  Gene Name: acyl-CoA thioesterase 9;
  ENSP ID: ENSP00000417778
MEERKLLHSFLAKSQDGLPPRRMKDSYIEVLLPLGSEPELREKYLTVQNTVRFGRILEDLDSLGVLICYMHNKIHSAKMSPLSIVTALVDKIDMCKKSLSPEQDIKFSGHVSWVGKTSMEVKMQMFQAGICKSTHP

SEQ ID NO: 2095 - protein, 46 aa, Homo sapiens
  Payload ID: 528;
  Gene Symbol: ACOT9;
  Gene Name: acyl-CoA thioesterase 9;
  ENSP ID: ENSP00000420238
MRRAALRLCALGKGQLTPGRGLTQGPQNPKKQGIFHIHEGKHGVSV

SEQ ID NO: 2096 - protein, 264 aa, Homo sapiens
  Payload ID: 528;
  Gene Symbol: ACOT9;
  Gene Name: acyl-CoA thioesterase 9;
  ENSP ID: ENSP00000420490
IVGASTNWRDHVKAMEERKLLHSFLAKSQDGLPPRRMKDSYIEVLLPLGSEPELREKYLTVQNTVRFGRILEDLDSLGDMCKKSLSPEQDIKFSGHVSWVGKTSMEVKMQMFQLHGDEFCPVLDATFVMVARDSENKGPAFVNPLIPESPEEEELFRQGELNKGRRIAFSSTSLLKMAPSAEERTTIHEMFLSTLDPKTISFRSRVLPSNAVWMENSKLKSLEICHPQERNIFNRIFGGFLMRKAYELAWATACSFGGSRPFVV

SEQ ID NO: 2097 - protein, 328 aa, Homo sapiens
  Payload ID: 529;
  Gene Symbol: AWAT1;
  Gene Name: acyl-CoA wax alcohol acyltransferase 1;
  Uniprot ID:  Q58HT5;
  ENSP ID: ENSP00000363645
MAHSKQPSHFQSLMLLQWPLSYLAIFWILQPLFVYLLFTSLWPLPVLYFAWLFLDWKTPERGGRRSAWVRNWCVWTHIRDYFPITILKTKDLSPEHNYLMGVHPHGLLTFGAFCNFCTEATGFSKTFPGITPHLATLSWFFKIPFVREYLMAKGVCSVSQPAINYLLSHGTGNLVGIVVGGVGEALQSVPNTTTLILQKRKGFVRTALQHGAHLVPTFTFGETEVYDQVLFHKDSRMYKFQSCFRRIFGFYCCVFYGQSFCQGSTGLLPYSRPIVTVVGEPLPLPQIEKPSQEMVDKYHALYMDALHKLFDQHKTHYGCSETQKLFFL

SEQ ID NO: 2098 - protein, 333 aa, Homo sapiens
  Payload ID: 530;
  Gene Symbol: AWAT2;
  Gene Name: acyl-CoA wax alcohol acyltransferase 2;
  Uniprot ID:  Q6E213;
  ENSP ID: ENSP00000421172
MLLPSKKDLKTALDVFAVFQWSFSALLITTTVIAVNLYLVVFTPYWPVTVLILTWLAFDWKTPQRGGRRFTCVRHWRLWKHYSDYFPLKLLKTHDICPSRNYILVCHPHGLFAHGWFGHFATEASGFSKIFPGITPYILTLGAFFWMPFLREYVMSTGACSVSRSSIDFLLTHKGTGNMVIVVIGGLAECRYSLPGSSTLVLKNRSGFVRMALQHGVPLIPAYAFGETDLYDQHIFTPGGFVNRFQKWFQSMVHIYPCAFYGRGFTKNSWGLLPYSRPVTTIVGEPLPMPKIENPSQEIVAKYHTLYIDALRKLFDQHKTKFGISETQELEII

SEQ ID NO: 2099 - protein, 166 aa, Homo sapiens
  Payload ID: 530;
  Gene Symbol: AWAT2;
  Gene Name: acyl-CoA wax alcohol acyltransferase 2;
  ENSP ID: ENSP00000427523
EASGFSKIFPGITPYILTLGAFFWMPFLREYVMSTGACSVSRSSIDFLLTHKGTGNMVIVVIGGLAECRYSLPGSSTLVLKNRSGFVRMALQHGQPGVGHGAPTLNLDLGTAGLGSEKPVGRPRDHAPSACLAFDKVPTFLGFRRYAFALQGASNTCLCLWGDGPL

SEQ ID NO: 2100 - protein, 422 aa, Homo sapiens
  Payload ID: 531;
  Gene Symbol: AGK;
  Gene Name: acylglycerol kinase;
  Uniprot ID:  Q53H12;
  ENSP ID: ENSP00000347581
MTVFFKTLRNHWKKTTAGLCLLTWGGHWLYGKHCDNLLRRAACQEAQVFGNQLIPPNAQVKKATVFLNPAACKGKARTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGSRKVRNPKLHVEGTECLQASQCTLLIPEGAGGSFSIDSEEYEAMPVEVKLLPRKLQFFCDPRKREQMLTSPTQ

SEQ ID NO: 2101 - protein, 244 aa, Homo sapiens
  Payload ID: 531;
  Gene Symbol: AGK;
  Gene Name: acylglycerol kinase;
  ENSP ID: ENSP00000418101
MTVFFKTLRNHWKKTTAGLCLLTWGGHWLYGKHCDNLLRRAACQEAQVFGNQLIPPNAQVKKATVFLNPAACKGTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKPFPKR

SEQ ID NO: 2102 - protein, 65 aa, Homo sapiens
  Payload ID: 531;
  Gene Symbol: AGK;
  Gene Name: acylglycerol kinase;
  Uniprot ID:  Q53H12;
  ENSP ID: ENSP00000418789
MTVFFKTLRNHWKKTTAGLCLLTWGGHWLYGKHCDNLLRRAACQEAQHYQDESRWEPTLSRTPGS

SEQ ID NO: 2103 - protein, 46 aa, Homo sapiens
  Payload ID: 531;
  Gene Symbol: AGK;
  Gene Name: acylglycerol kinase;
  ENSP ID: ENSP00000420540
MTVFFKTLRNHWKKTTAGLCLLTWGGHWLYGKHWCLAINSFLPMHK

SEQ ID NO: 2104 - protein, 394 aa, Homo sapiens
  Payload ID: 531;
  Gene Symbol: AGK;
  Gene Name: acylglycerol kinase;
  ENSP ID: ENSP00000420776
MENTDSDNLLRRAACQEAQVFGNQLIPPNAQVKKATVFLNPAACKGKARTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGSRKVRNPKLHVEGTECLQASQCTLLIPEGAGGSFSIDSEEYEAMPVEVKLLPRKLQFFCDPRKREQMLTSPTQ

SEQ ID NO: 2105 - protein, 226 aa, Homo sapiens
  Payload ID: 531;
  Gene Symbol: AGK;
  Gene Name: acylglycerol kinase;
  Uniprot ID:  Q53H12;
  ENSP ID: ENSP00000458417
GEKEQPVFAMTGLRWGSFRDAGVKVSKYWYLGPLKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGSRKVRNPKLHVEGTECLQASQCTLLIPEGAGGSFSIDSEEYEAMPVEVKLLPRKLQFFCDPRKREQMLTSPTQ

SEQ ID NO: 2106 - protein, 51 aa, Homo sapiens
  Payload ID: 531;
  Gene Symbol: AGK;
  Gene Name: acylglycerol kinase;
  ENSP ID: ENSP00000459752
GEKEQPVFAMTGLRWGSFRDAGVKVSKYWYLGPLKIKAAHFFSTLKPFPKR

SEQ ID NO: 2107 - protein, 226 aa, Homo sapiens; identical to SEQ ID NO: 2105
  Payload ID: 531;
  Gene Symbol: AGK;
  Gene Name: acylglycerol kinase;
  ENSP ID: ENSP00000461611

SEQ ID NO: 2108 - protein, 244 aa, Homo sapiens; identical to SEQ ID NO: 2101
  Payload ID: 531;
  Gene Symbol: AGK;
  Gene Name: acylglycerol kinase;
  ENSP ID: ENSP00000487274

SEQ ID NO: 2109 - protein, 108 aa, Homo sapiens
  Payload ID: 532;
  Gene Symbol: AOAH;
  Gene Name: acyloxyacyl hydrolase (neutrophil);
  ENSP ID: ENSP00000416051
MQSPWKILTVAPLFLLLSLQSSASPANDDQSRPSLSNGHTCVEKLFLKTTCYLVIDKFGSDIIKLLSADMNADVVCHTLEFCKQNTGQPLCHLYPLPKETWKFTLQKA

SEQ ID NO: 2110 - protein, 52 aa, Homo sapiens
  Payload ID: 532;
  Gene Symbol: AOAH;
  Gene Name: acyloxyacyl hydrolase (neutrophil);
  ENSP ID: ENSP00000416472
MQSPWKILTVAPLFLLLSLQSSASPANDDQSRPSLSNGHTCVASSAEKPQLS

SEQ ID NO: 2111 - protein, 688 aa, Homo sapiens
  Payload ID: 532;
  Gene Symbol: AOAH;
  Gene Name: acyloxyacyl hydrolase (neutrophil);
  ENSP ID: ENSP00000479664
MQSPWKILTVAPLFLLLSLQSSASPANDDQSRPSLSNGHTCVGCVLVVSVIEQLAQVHNSTVQASMERLCSYLPEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIESLSRNKVLDYPAIVIYAMIGNDVCSGKSDPVPAMTTPEKLYSNVMQTLKHLNSHLPNGSHVILYGLPDGTFLWDNLHNRYHPLGQLNKDMTYAQLYSFLNCLQVSPCHGWMSSNKTLRTLTSERAEQLSNTLKKIAASEKFTNFNLFYMDFAFHEIIQEWQKRGGQPWQLIEPVDGFHPNERKSILLKGILMTSQTLDNQEWTQLTSWIKGNLTCDSRTREWLCCCWRIISGKRCSSSGPKSWERRIRSTPRLNRCLETKAGTEPLRSMHPWGAQGGRGLGKLIPQTLWGLPRHRPKGLFFSSIFAKCLSLNEEHIWTTVQCCVLPGSVTLPLFLK

SEQ ID NO: 2112 - protein, 575 aa, Homo sapiens
  Payload ID: 532;
  Gene Symbol: AOAH;
  Gene Name: acyloxyacyl hydrolase (neutrophil);
  Uniprot ID:  P28039;
  ENSP ID: ENSP00000483783
MQSPWKILTVAPLFLLLSLQSSASPANDDQSRPSLSNGHTCVGCVLVVSVIEQLAQVHNSTVQASMERLCSYLPEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIESLSRNKVLDYPAIVIYAMIGNDVCSGKSDPVPAMTTPEKLYSNVMQTLKHLNSHLPNGSHVILYGLPDGTFLWDNLHNRYHPLGQLNKDMTYAQLYSFLNCLQVSPCHGWMSSNKTLRTLTSERAEQLSNTLKKIAASEKFTNFNLFYMDFAFHEIIQEWQKRGGQPWQLIEPVDGFHPNEVALLLLADHFWKKVQLQWPQILGKENPFNPQIKQVFGDQGGH

SEQ ID NO: 2113 - protein, 543 aa, Homo sapiens
  Payload ID: 532;
  Gene Symbol: AOAH;
  Gene Name: acyloxyacyl hydrolase (neutrophil);
  Uniprot ID:  P28039;
  ENSP ID: ENSP00000484305
MQSPWKILTVAPLFLLLSLQSSASPANDDQSRPSLSNGHTCVEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIESLSRNKVLDYPAIVIYAMIGNDVCSGKSDPVPAMTTPEKLYSNVMQTLKHLNSHLPNGSHVILYGLPDGTFLWDNLHNRYHPLGQLNKDMTYAQLYSFLNCLQVSPCHGWMSSNKTLRTLTSERAEQLSNTLKKIAASEKFTNFNLFYMDFAFHEIIQEWQKRGGQPWQLIEPVDGFHPNEVALLLLADHFWKKVQLQWPQILGKENPFNPQIKQVFGDQGGH

SEQ ID NO: 2114 - protein, 99 aa, Homo sapiens
  Payload ID: 533;
  Gene Symbol: ACYP1;
  Gene Name: acylphosphatase 1, erythrocyte (common) type;
  Uniprot ID:  P07311;
  ENSP ID: ENSP00000238618
MAEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 2115 - protein, 55 aa, Homo sapiens
  Payload ID: 533;
  Gene Symbol: ACYP1;
  Gene Name: acylphosphatase 1, erythrocyte (common) type;
  Uniprot ID:  P07311;
  ENSP ID: ENSP00000350655
MAEGNTLISVDYEIFGKVQGVFFRKHTQEMTVENRIAETHSKSCVPVSFATSYAG

SEQ ID NO: 2116 - protein, 129 aa, Homo sapiens
  Payload ID: 533;
  Gene Symbol: ACYP1;
  Gene Name: acylphosphatase 1, erythrocyte (common) type;
  ENSP ID: ENSP00000450873
MPASARLAGAGLLLAFLRALGCAGRAPGLSMAEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 2117 - protein, 37 aa, Homo sapiens
  Payload ID: 533;
  Gene Symbol: ACYP1;
  Gene Name: acylphosphatase 1, erythrocyte (common) type;
  ENSP ID: ENSP00000451220
MAEGNTLISVDYEIFGKVQGVFFRKHTQVCGLQALGW

SEQ ID NO: 2118 - protein, 99 aa, Homo sapiens; identical to SEQ ID NO: 2114
  Payload ID: 533;
  Gene Symbol: ACYP1;
  Gene Name: acylphosphatase 1, erythrocyte (common) type;
  Uniprot ID:  P07311;
  ENSP ID: ENSP00000451581

SEQ ID NO: 2119 - protein, 62 aa, Homo sapiens
  Payload ID: 533;
  Gene Symbol: ACYP1;
  Gene Name: acylphosphatase 1, erythrocyte (common) type;
  ENSP ID: ENSP00000452249
MAEGNTLISVDYEIFGKVQGVFFRKHTQEMTVENRIAETHSKSCVPVSFATSYAGINEFKRI

SEQ ID NO: 2120 - protein, 98 aa, Homo sapiens
  Payload ID: 534;
  Gene Symbol: ACYP2;
  Gene Name: acylphosphatase 2, muscle type;
  ENSP ID: ENSP00000306448
MCPLPLAAAAVAAPRAPLRLLNRGLAAAMSTAQSLKSVDYEVFGRVQGVCFRMYTEDEARKIGVVGWVKNTSKGTVTGQVQGPEDKVNSMNSSAPEAG

SEQ ID NO: 2121 - protein, 99 aa, Homo sapiens
  Payload ID: 534;
  Gene Symbol: ACYP2;
  Gene Name: acylphosphatase 2, muscle type;
  Uniprot ID:  P14621;
  ENSP ID: ENSP00000378161
MSTAQSLKSVDYEVFGRVQGVCFRMYTEDEARKIGVVGWVKNTSKGTVTGQVQGPEDKVNSMKSWLSKVGSPSSRIDRTNFSNEKTISKLEYSNFSIRY

SEQ ID NO: 2122 - protein, 97 aa, Homo sapiens
  Payload ID: 534;
  Gene Symbol: ACYP2;
  Gene Name: acylphosphatase 2, muscle type;
  ENSP ID: ENSP00000385674
MCPLPLAAAAVAAPRAPLRLLNRGLAAAMSTAQSLKSVDYEVFGRVQGVCFRMYTEDEARKIGVVGWVKNTSKGTVTGQVQGPEDKVNSMLECSGLI

SEQ ID NO: 2123 - protein, 66 aa, Homo sapiens
  Payload ID: 534;
  Gene Symbol: ACYP2;
  Gene Name: acylphosphatase 2, muscle type;
  ENSP ID: ENSP00000475312
  MOD_RES (1)..(1): Any amino acid
XAQSLKSVDYEVFGRVQGVCFRMYTEDEARKIGVVGWVKNTSKGTVTGQVQGPEDKVNSILAFPFY

SEQ ID NO: 2124 - protein, 83 aa, Homo sapiens
  Payload ID: 534;
  Gene Symbol: ACYP2;
  Gene Name: acylphosphatase 2, muscle type;
  ENSP ID: ENSP00000475333
MTALVLQIEYTEDEARKIGVVGWVKNTSKGTVTGQVQGPEDKVNSMKSWLSKVGSPSSRIDRTNFSNEKTISKLEYSNFSIRY

SEQ ID NO: 2125 - protein, 40 aa, Homo sapiens
  Payload ID: 534;
  Gene Symbol: ACYP2;
  Gene Name: acylphosphatase 2, muscle type;
  ENSP ID: ENSP00000475424
MLLTQSLFGGLFPRTRETMRREAVPDDNELPRNKHLNWKS

SEQ ID NO: 2126 - protein, 116 aa, Homo sapiens
  Payload ID: 534;
  Gene Symbol: ACYP2;
  Gene Name: acylphosphatase 2, muscle type;
  ENSP ID: ENSP00000475658
MLLTQSLFGGLFPRTRETMRRYKVSLFYLGCSRTPNVKLSSCLGLPCCWDYSYKFIQLSEFGFGQVIIVSEEPWKENISCSSTTFIKSTICLNPDSEFRPCFNAWLSLIRENAVGL

SEQ ID NO: 2127 - protein, 172 aa, Homo sapiens
  Payload ID: 534;
  Gene Symbol: ACYP2;
  Gene Name: acylphosphatase 2, muscle type;
  ENSP ID: ENSP00000475986
MLLTQSLFGGLFPRTRETMRRYKVSLFYLGCSRTPNVKLSSCLGLPCCWDYSYKFIQLSEFGFGQVIIVSEEPWKENISCSSTTFIKSTICLSVCFRMYTEDEARKIGVVGWVKNTSKGTVTGQVQGPEDKVNSMKSWLSKVGSPSSRIDRTNFSNEKTISKLEYSNFSIRY

SEQ ID NO: 2128 - protein, 97 aa, Homo sapiens
  Payload ID: 535;
  Gene Symbol:;
  Gene Name: AD000671.6;
  ENSP ID: ENSP00000472696
MAEYLASIFGTEKDKVNCSFYFKIGVCRHGDRCSRLHNKPTFSQPCPLSSGPAPFKFCADHSAAQPVPESTEHSPNCRRITLRCSQNCRRSMGRLKR

SEQ ID NO: 2129 - protein, 748 aa, Homo sapiens
  Payload ID: 536;
  Gene Symbol: ADAM10;
  Gene Name: ADAM metallopeptidase domain 10;
  Uniprot ID:  O14672;
  ENSP ID: ENSP00000260408
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 2130 - protein, 71 aa, Homo sapiens
  Payload ID: 536;
  Gene Symbol: ADAM10;
  Gene Name: ADAM metallopeptidase domain 10;
  ENSP ID: ENSP00000386056
MVLLRVLILLLSWAAGMGDRDFDDGVLGLAWVGAPSGSSGGICEKSKLYSDVPTMGKLHSKEKPIKSSSPN

SEQ ID NO: 2131 - protein, 125 aa, Homo sapiens
  Payload ID: 536;
  Gene Symbol: ADAM10;
  Gene Name: ADAM metallopeptidase domain 10;
  ENSP ID: ENSP00000391930
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYDYPHKYGPQGGCADHSV

SEQ ID NO: 2132 - protein, 38 aa, Homo sapiens
  Payload ID: 536;
  Gene Symbol: ADAM10;
  Gene Name: ADAM metallopeptidase domain 10;
  ENSP ID: ENSP00000452639
MVLLRVLILLLSWAAGMGVPTMGKLHSKEKPIKSSSPN

SEQ ID NO: 2133 - protein, 115 aa, Homo sapiens
  Payload ID: 536;
  Gene Symbol: ADAM10;
  Gene Name: ADAM metallopeptidase domain 10;
  ENSP ID: ENSP00000452704
MVLLRVLILLLSWAAGMGGQYGNPLNKYIRHYEGLSYNVDSLHQKHQRAKRAVSHEDQFLRLDFHAHGRDGVLPCCPGWSQTPGLKRSTCLSLPQCWDYRCEPSPMISVFDYPHK

SEQ ID NO: 2134 - protein, 148 aa, Homo sapiens
  Payload ID: 536;
  Gene Symbol: ADAM10;
  Gene Name: ADAM metallopeptidase domain 10;
  ENSP ID: ENSP00000453952
MVLLRVLILLLSWAAGMGDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRN

SEQ ID NO: 2135 - protein, 58 aa, Homo sapiens
  Payload ID: 536;
  Gene Symbol: ADAM10;
  Gene Name: ADAM metallopeptidase domain 10;
  ENSP ID: ENSP00000456542
  MOD_RES (1)..(1): Any amino acid
XEEGSFSHGSVIDGRFEGFIQTRGGTFYVEPAERYIKDRTLPFHSVIYHEDDISEGLN

SEQ ID NO: 2136 - protein, 59 aa, Homo sapiens
  Payload ID: 536;
  Gene Symbol: ADAM10;
  Gene Name: ADAM metallopeptidase domain 10;
  ENSP ID: ENSP00000481779
MVLLRVLILLLSWAAGMGAPARWRIPKSSPPPRPAAQTRGKLCCLQLGSCIVLYPARRS

SEQ ID NO: 2137 - protein, 769 aa, Homo sapiens
  Payload ID: 537;
  Gene Symbol: ADAM11;
  Gene Name: ADAM metallopeptidase domain 11;
  Uniprot ID:  O75078;
  ENSP ID: ENSP00000200557
MRLLRRWAFAALLLSLLPTPGLGTQGPAGALRWGGLPQLGGPGAPEVTEPSRLVRESSGGEVRKQQLDTRVRQEPPGGPPVHLAQVSFVIPAFNSNFTLDLELNHHLLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRQVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSKQDVLCGFLLCVNISGAPRLGDLVGDISSVTFYHQGKELDCRGGHVQLADGSDLSYVEDGTACGPNMLCLDHRCLPASAFNFSTCPGSGERRICSHHGVCSNEGKCICQPDWTGKDCSIHNPLPTSPPTGETERYKGPSGTNIIIGSIAGAVLVAAIVLGGTGWGFKNIRRGRSGGA

SEQ ID NO: 2138 - protein, 241 aa, Homo sapiens
  Payload ID: 537;
  Gene Symbol: ADAM11;
  Gene Name: ADAM metallopeptidase domain 11;
  ENSP ID: ENSP00000347856
MRLLRRWAFAALLLSLLPTPGLGTQGPAGALRWGGLPQLGGPGAPEVTEPSRLVRESSGGEVRKQQLDTRVRQEPPGGPPVHLAQVSFVIPAFNSNFTLDLELNHHLLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRSAGATLQCTVKPSMWS

SEQ ID NO: 2139 - protein, 569 aa, Homo sapiens
  Payload ID: 537;
  Gene Symbol: ADAM11;
  Gene Name: ADAM metallopeptidase domain 11;
  ENSP ID: ENSP00000443773
MQGTRLPVCCACPVGSSKPAEAEKEKVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSKQDVLCGFLLCVNISGAPRLGDLVGDISSVTFYHQGKELDCRGGHVQLADGSDLSYVEDGTACGPNMLCLDHRCLPASAFNFSTCPGSGERRICSHHGVCSNEGKCICQPDWTGKDCSIHNPLPTSPPTGETERYKGPSGTNIIIGSIAGAVLVAAIVLGGTGWGFKNIRRGRSGGA

SEQ ID NO: 2140 - protein, 517 aa, Homo sapiens
  Payload ID: 537;
  Gene Symbol: ADAM11;
  Gene Name: ADAM metallopeptidase domain 11;
  ENSP ID: ENSP00000465537
LLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRQVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSKQPQQGRAVWLPPLCQHLWSSSARGPGGRHQ

SEQ ID NO: 2141 - protein, 738 aa, Homo sapiens
  Payload ID: 538;
  Gene Symbol: ADAM12;
  Gene Name: ADAM metallopeptidase domain 12;
  Uniprot ID:  O43184;
  ENSP ID: ENSP00000357665
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQAEARQEAAESNRERGQGQEPVGSQEHASTASLTLI

SEQ ID NO: 2142 - protein, 909 aa, Homo sapiens
  Payload ID: 538;
  Gene Symbol: ADAM12;
  Gene Name: ADAM metallopeptidase domain 12;
  Uniprot ID:  O43184;
  ENSP ID: ENSP00000357668
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 2143 - protein, 278 aa, Homo sapiens
  Payload ID: 538;
  Gene Symbol: ADAM12;
  Gene Name: ADAM metallopeptidase domain 12;
  ENSP ID: ENSP00000391268
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFT

SEQ ID NO: 2144 - protein, 814 aa, Homo sapiens
  Payload ID: 539;
  Gene Symbol: ADAM15;
  Gene Name: ADAM metallopeptidase domain 15;
  Uniprot ID:  Q13444;
  ENSP ID: ENSP00000271836
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 2145 - protein, 839 aa, Homo sapiens
  Payload ID: 539;
  Gene Symbol: ADAM15;
  Gene Name: ADAM metallopeptidase domain 15;
  Uniprot ID:  Q13444;
  ENSP ID: ENSP00000348227
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKQASALSFPAPPSRPLPPDPVSKRLQSQGPAKPPPPRKPLPADPQGRCPSGDLPGPGAGIPPLVVPSRPAPPPPTVSSLYL

SEQ ID NO: 2146 - protein, 863 aa, Homo sapiens
  Payload ID: 539;
  Gene Symbol: ADAM15;
  Gene Name: ADAM metallopeptidase domain 15;
  Uniprot ID:  Q13444;
  ENSP ID: ENSP00000349436
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKQASALSFPAPPSRPLPPDPVSKRLQAELADRPNPPTRPLPADPVVRSPKSQGPAKPPPPRKPLPADPQGRCPSGDLPGPGAGIPPLVVPSRPAPPPPTVSSLYL

SEQ ID NO: 2147 - protein, 838 aa, Homo sapiens
  Payload ID: 539;
  Gene Symbol: ADAM15;
  Gene Name: ADAM metallopeptidase domain 15;
  Uniprot ID:  Q13444;
  ENSP ID: ENSP00000352226
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKAELADRPNPPTRPLPADPVVRSPKSQGPAKPPPPRKPLPADPQGRCPSGDLPGPGAGIPPLVVPSRPAPPPPTVSSLYL

SEQ ID NO: 2148 - protein, 772 aa, Homo sapiens
  Payload ID: 539;
  Gene Symbol: ADAM15;
  Gene Name: ADAM metallopeptidase domain 15;
  Uniprot ID:  Q13444;
  ENSP ID: ENSP00000353892
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYSLRGQPSPHPQGSHCLPTPRAGAHRVTCPAQGLESRP

SEQ ID NO: 2149 - protein, 796 aa, Homo sapiens
  Payload ID: 539;
  Gene Symbol: ADAM15;
  Gene Name: ADAM metallopeptidase domain 15;
  Uniprot ID:  Q13444;
  ENSP ID: ENSP00000357397
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRLVLSASRPPLPGRCRLTLCPRDSSLRGQPSPHPQGSHCLPTPRAGAHRVTCPAQGLESRP

SEQ ID NO: 2150 - protein, 520 aa, Homo sapiens
  Payload ID: 539;
  Gene Symbol: ADAM15;
  Gene Name: ADAM metallopeptidase domain 15;
  Uniprot ID:  Q13444;
  ENSP ID: ENSP00000357398
MRLALLWALGLLGAGSPLPSWPLPNIGGTEEQQAESEKAPREPLEPQVLQDDLPISLKKVLQTSLPEPLRIKLELDGDSHILELLQNRELVPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 2151 - protein, 862 aa, Homo sapiens
  Payload ID: 539;
  Gene Symbol: ADAM15;
  Gene Name: ADAM metallopeptidase domain 15;
  Uniprot ID:  Q13444;
  ENSP ID: ENSP00000403843
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKASALSFPAPPSRPLPPDPVSKRLQAELADRPNPPTRPLPADPVVRSPKSQGPAKPPPPRKPLPADPQGRCPSGDLPGPGAGIPPLVVPSRPAPPPPTVSSLYL

SEQ ID NO: 2152 - protein, 822 aa, Homo sapiens
  Payload ID: 539;
  Gene Symbol: ADAM15;
  Gene Name: ADAM metallopeptidase domain 15;
  Uniprot ID:  Q13444;
  ENSP ID: ENSP00000432347
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKQASALSFPAPPSRPLPPDPVSKRLQAELADRPNPPTRPLPADPVVRSPKVTVGGEKGTASPPT

SEQ ID NO: 2153 - protein, 824 aa, Homo sapiens
  Payload ID: 539;
  Gene Symbol: ADAM15;
  Gene Name: ADAM metallopeptidase domain 15;
  Uniprot ID:  Q13444;
  ENSP ID: ENSP00000432927
MRLALLWALGLLGAGSPLPSWPLPNIVLSWGVLGPAGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 2154 - protein, 797 aa, Homo sapiens
  Payload ID: 539;
  Gene Symbol: ADAM15;
  Gene Name: ADAM metallopeptidase domain 15;
  Uniprot ID:  Q13444;
  ENSP ID: ENSP00000434227
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKAELADRPNPPTRPLPADPVVRSPKVTVGGEKGTASPPT

SEQ ID NO: 2155 - protein, 633 aa, Homo sapiens
  Payload ID: 539;
  Gene Symbol: ADAM15;
  Gene Name: ADAM metallopeptidase domain 15;
  Uniprot ID:  Q13444;
  ENSP ID: ENSP00000476000
MRLALLWALGLLGAGSPLPSWPLPNIVSACNVEAPQVALRSSRQSQRRPRGSPWSPRSFRTISQLASKRCFRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVSSLGGQDQV

SEQ ID NO: 2156 - protein, 824 aa, Homo sapiens
  Payload ID: 540;
  Gene Symbol: ADAM17;
  Gene Name: ADAM metallopeptidase domain 17;
  Uniprot ID:  P78536;
  ENSP ID: ENSP00000309968
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 2157 - protein, 285 aa, Homo sapiens
  Payload ID: 540;
  Gene Symbol: ADAM17;
  Gene Name: ADAM metallopeptidase domain 17;
  ENSP ID: ENSP00000418728
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQLLFE

SEQ ID NO: 2158 - protein, 258 aa, Homo sapiens
  Payload ID: 540;
  Gene Symbol: ADAM17;
  Gene Name: ADAM metallopeptidase domain 17;
  ENSP ID: ENSP00000480552
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIHTDRAN

SEQ ID NO: 2159 - protein, 739 aa, Homo sapiens
  Payload ID: 541;
  Gene Symbol: ADAM18;
  Gene Name: ADAM metallopeptidase domain 18;
  Uniprot ID:  Q9Y3Q7;
  ENSP ID: ENSP00000265707
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQIKNLSKLLPQYLEIYIIVEKALYDYMGSEMMAVTQKIVQVIGLVNTMFTQFKLTVILSSLELWSNENQISTSGDADDILQRFLAWKRDYLILRPHDIAYLLVYRKHPKYVGATFPGTVCNKSYDAGIAMYPDAIGLEGFSVIIAQLLGLNVGLTYDDITQCFCLRATCIMNHEAVSASGRKIFSNCSMHDYRYFVSKFETKCLQKLSNLQPLHQNQPVCGNGILESNEECDCGNKNECQFKKCCDYNTCKLKGSVKCGSGPCCTSKCELSIAGTPCRKSIDPECDFTEYCNGTSSNCVPDTYALNGRLCKLGTAYCYNGQCQTTDNQCAKIFGKGAQGAPFACFKEVNSLHERSENCGFKNSQPLPCERKDVLCGKLACVQPHKNANKSDAQSTVYSYIQDHVCVSIATGSSMRSDGTDNAYVADGTMCGPEMYCVNKTCRKVHLMGYNCNATTKCKGKGICNNFGNCQCFPGHRPPDCKFQFGSPGGSIDDGNFQKSGDFYTEKGYNTHWNNWFILSFCIFLPFFIVFTTVIFKRNEISKSCNRENAEYNRNSSVVSESDDVGH

SEQ ID NO: 2160 - protein, 715 aa, Homo sapiens
  Payload ID: 541;
  Gene Symbol: ADAM18;
  Gene Name: ADAM metallopeptidase domain 18;
  Uniprot ID:  Q9Y3Q7;
  ENSP ID: ENSP00000369195
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQIKNLSKLLPQYLEIYIIVEKALMFTQFKLTVILSSLELWSNENQISTSGDADDILQRFLAWKRDYLILRPHDIAYLLVYRKHPKYVGATFPGTVCNKSYDAGIAMYPDAIGLEGFSVIIAQLLGLNVGLTYDDITQCFCLRATCIMNHEAVSASGRKIFSNCSMHDYRYFVSKFETKCLQKLSNLQPLHQNQPVCGNGILESNEECDCGNKNECQFKKCCDYNTCKLKGSVKCGSGPCCTSKCELSIAGTPCRKSIDPECDFTEYCNGTSSNCVPDTYALNGRLCKLGTAYCYNGQCQTTDNQCAKIFGKGAQGAPFACFKEVNSLHERSENCGFKNSQPLPCERKDVLCGKLACVQPHKNANKSDAQSTVYSYIQDHVCVSIATGSSMRSDGTDNAYVADGTMCGPEMYCVNKTCRKVHLMGYNCNATTKCKGKGICNNFGNCQCFPGHRPPDCKFQFGSPGGSIDDGNFQKSGDFYTEKGYNTHWNNWFILSFCIFLPFFIVFTTVIFKRNEISKSCNRENAEYNRNSSVVSESDDVGH

SEQ ID NO: 2161 - protein, 115 aa, Homo sapiens
  Payload ID: 541;
  Gene Symbol: ADAM18;
  Gene Name: ADAM metallopeptidase domain 18;
  ENSP ID: ENSP00000428083
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLR

SEQ ID NO: 2162 - protein, 62 aa, Homo sapiens
  Payload ID: 541;
  Gene Symbol: ADAM18;
  Gene Name: ADAM metallopeptidase domain 18;
  ENSP ID: ENSP00000429335
MFLLLALLTELGRLQAHEGSEGIFLHVTVPRKIKSNDSEVSERKVFGEQVVFGYMNDLHHYN

SEQ ID NO: 2163 - protein, 182 aa, Homo sapiens
  Payload ID: 541;
  Gene Symbol: ADAM18;
  Gene Name: ADAM metallopeptidase domain 18;
  Uniprot ID:  Q9Y3Q7;
  ENSP ID: ENSP00000429908
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQVTVIILML

SEQ ID NO: 2164 - protein, 739 aa, Homo sapiens; identical to SEQ ID NO: 2159
  Payload ID: 541;
  Gene Symbol: ADAM18;
  Gene Name: ADAM metallopeptidase domain 18;
  Uniprot ID:  Q9Y3Q7;
  ENSP ID: ENSP00000482348

SEQ ID NO: 2165 - protein, 115 aa, Homo sapiens; identical to SEQ ID NO: 2161
  Payload ID: 541;
  Gene Symbol: ADAM18;
  Gene Name: ADAM metallopeptidase domain 18;
  ENSP ID: ENSP00000484966

SEQ ID NO: 2166 - protein, 182 aa, Homo sapiens; identical to SEQ ID NO: 2163
  Payload ID: 541;
  Gene Symbol: ADAM18;
  Gene Name: ADAM metallopeptidase domain 18;
  Uniprot ID:  Q9Y3Q7;
  ENSP ID: ENSP00000488128

SEQ ID NO: 2167 - protein, 715 aa, Homo sapiens; identical to SEQ ID NO: 2160
  Payload ID: 541;
  Gene Symbol: ADAM18;
  Gene Name: ADAM metallopeptidase domain 18;
  Uniprot ID:  Q9Y3Q7;
  ENSP ID: ENSP00000488176

SEQ ID NO: 2168 - protein, 62 aa, Homo sapiens; identical to SEQ ID NO: 2162
  Payload ID: 541;
  Gene Symbol: ADAM18;
  Gene Name: ADAM metallopeptidase domain 18;
  ENSP ID: ENSP00000488816

SEQ ID NO: 2169 - protein, 918 aa, Homo sapiens
  Payload ID: 542;
  Gene Symbol: ADAM19;
  Gene Name: ADAM metallopeptidase domain 19;
  Uniprot ID:  Q9H013;
  ENSP ID: ENSP00000257527
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKFPEYRSQRAGGMISSKI

SEQ ID NO: 2170 - protein, 272 aa, Homo sapiens
  Payload ID: 542;
  Gene Symbol: ADAM19;
  Gene Name: ADAM metallopeptidase domain 19;
  ENSP ID: ENSP00000428376
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKVRPVLPILEHPDCSRGLGSVDPREHV

SEQ ID NO: 2171 - protein, 955 aa, Homo sapiens
  Payload ID: 542;
  Gene Symbol: ADAM19;
  Gene Name: ADAM metallopeptidase domain 19;
  Uniprot ID:  Q9H013;
  ENSP ID: ENSP00000428654
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKVSPREALKVKAGTRGLQGGRCRVEKTKQFMLLVVWTELPEQKPRAKHSCFLVPA

SEQ ID NO: 2172 - protein, 489 aa, Homo sapiens
  Payload ID: 542;
  Gene Symbol: ADAM19;
  Gene Name: ADAM metallopeptidase domain 19;
  ENSP ID: ENSP00000431027
  MOD_RES (1)..(1): Any amino acid
XDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKRVWKTCNLKTGDQFQSQ

SEQ ID NO: 2173 - protein, 735 aa, Homo sapiens
  Payload ID: 543;
  Gene Symbol: ADAM2;
  Gene Name: ADAM metallopeptidase domain 2;
  Uniprot ID:  Q99965;
  ENSP ID: ENSP00000265708
MWRVLFLLSGLGGLRMDSNFDSLPVQITVPEKIRSIIKEGIESQASYKIVIEGKPYTVNLMQKNFLPHNFRVYSYSGTGIMKPLDQDFQNFCHYQGYIEGYPKSVVMVSTCTGLRGVLQFENVSYGIEPLESSVGFEHVIYQVKHKKADVSLYNEKDIESRDLSFKLQSVEPQQDFAKYIEMHVIVEKQLYNHMGSDTTVVAQKVFQLIGLTNAIFVSFNITIILSSLELWIDENKIATTGEANELLHTFLRWKTSYLVLRPHDVAFLLVYREKSNYVGATFQGKMCDANYAGGVVLHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEADNLQCGKLICKYVGKFLLQIPRATIIYANISGHLCIAVEFASDHADSQKMWIKDGTSCGSNKVCRNQRCVSSSYLGYDCTTDKCNDRGVCNNKKHCHCSASYLPPDCSVQSDLWPGGSIDSGNFPPVAIPARLPERRYIENIYHSKPMRWPFFLFIPFFIIFCVLIAIMVKVNFQRKKWRTEDYSSDEQPESESEPKG

SEQ ID NO: 2174 - protein, 716 aa, Homo sapiens
  Payload ID: 543;
  Gene Symbol: ADAM2;
  Gene Name: ADAM metallopeptidase domain 2;
  Uniprot ID:  Q99965;
  ENSP ID: ENSP00000343854
MWRVLFLLSGLGGLRMDSNFDSLPVQITVPEKIRSIIKEGIESQASYKIVIEGKPYTVNLMQKNFLPHNFRVYSYSGTGIMKPLDQDFQNFCHYQGYIEGYPKSVVMVSTCTGLRGVLQFENVSYGIEPLESSVGFEHVIYQVKHKKADVSLYNEKDIESRDLSFKLQSVEYNHMGSDTTVVAQKVFQLIGLTNAIFVSFNITIILSSLELWIDENKIATTGEANELLHTFLRWKTSYLVLRPHDVAFLLVYREKSNYVGATFQGKMCDANYAGGVVLHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEADNLQCGKLICKYVGKFLLQIPRATIIYANISGHLCIAVEFASDHADSQKMWIKDGTSCGSNKVCRNQRCVSSSYLGYDCTTDKCNDRGVCNNKKHCHCSASYLPPDCSVQSDLWPGGSIDSGNFPPVAIPARLPERRYIENIYHSKPMRWPFFLFIPFFIIFCVLIAIMVKVNFQRKKWRTEDYSSDEQPESESEPKG

SEQ ID NO: 2175 - protein, 579 aa, Homo sapiens
  Payload ID: 543;
  Gene Symbol: ADAM2;
  Gene Name: ADAM metallopeptidase domain 2;
  ENSP ID: ENSP00000369182
MWRVLFLLSGLGGLRMDSNFDSLPVQITVPEKIRSIIKEGIESQASYKIVIEGKPYTVNLMQKNFLPHNFRVYSYSGTGIMKPLDQDFQNFCHYQGYIEGYPKSVVMVSTCTGLRGVLQFENVSYGIEPLESSVGFEHVIYQVKHKKADVSLYNEKDIESRDLSFKLQSVEHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEADGHLCIAVEFASDHADSQKMWIKDGTSCGSNKVCRNQRCVSSSYLGYDCTTDKCNDRGVCNNKKHCHCSASYLPPDCSVQSDLWPGGSIDSGNFPPVAIPARLPERRYIENIYHSKPMRWPFFLFIPFFIIFCVLIAIMVKVNFQRKKWRTEDYSSDEQPESESEPKG

SEQ ID NO: 2176 - protein, 672 aa, Homo sapiens
  Payload ID: 543;
  Gene Symbol: ADAM2;
  Gene Name: ADAM metallopeptidase domain 2;
  ENSP ID: ENSP00000429352
MWRVLFLLSGLGGLRMDSNFDSLPVQITVPEKIRSIIKEGIESQASYKIVIEGKPYTVNLMQKNFLPHNFRVYSYSGTGIMKPLDQDFQNFCHYQGYIEGYPKSVVMVSTCTGLRGVLQFENVSYGIEPLESSVGFEHVIYQVKHKKADVSLYNEKDIESRDLSFKLQSVEPQQDFAKYIEMHVIVEKQLYNHMGSDTTVVAQKVFQLIGLTNAIFVSFNITIILSSLELWIDENKIATTGEANELLHTFLRWKTSYLVLRPHDVAFLLVYREKSNYVGATFQGKMCDANYAGGVVLHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEVCRNQRCVSSSYLGYDCTTDKCNDRGVCNNKKHCHCSASYLPPDCSVQSDLWPGGSIDSGNFPPVAIPARLPERRYIENIYHSKPMRWPFFLFIPFFIIFCVLIAIMVKVNFQRKKWRTEDYSSDEQPESESEPKG

SEQ ID NO: 2177 - protein, 672 aa, Homo sapiens; identical to SEQ ID NO: 2176
  Payload ID: 543;
  Gene Symbol: ADAM2;
  Gene Name: ADAM metallopeptidase domain 2;
  ENSP ID: ENSP00000478636

SEQ ID NO: 2178 - protein, 579 aa, Homo sapiens; identical to SEQ ID NO: 2175
  Payload ID: 543;
  Gene Symbol: ADAM2;
  Gene Name: ADAM metallopeptidase domain 2;
  ENSP ID: ENSP00000480574

SEQ ID NO: 2179 - protein, 735 aa, Homo sapiens; identical to SEQ ID NO: 2173
  Payload ID: 543;
  Gene Symbol: ADAM2;
  Gene Name: ADAM metallopeptidase domain 2;
  Uniprot ID:  Q99965;
  ENSP ID: ENSP00000482337

SEQ ID NO: 2180 - protein, 672 aa, Homo sapiens; identical to SEQ ID NO: 2176
  Payload ID: 543;
  Gene Symbol: ADAM2;
  Gene Name: ADAM metallopeptidase domain 2;
  ENSP ID: ENSP00000483607

SEQ ID NO: 2181 - protein, 716 aa, Homo sapiens; identical to SEQ ID NO: 2174
  Payload ID: 543;
  Gene Symbol: ADAM2;
  Gene Name: ADAM metallopeptidase domain 2;
  Uniprot ID:  Q99965;
  ENSP ID: ENSP00000484999

SEQ ID NO: 2182 - protein, 672 aa, Homo sapiens; identical to SEQ ID NO: 2176
  Payload ID: 543;
  Gene Symbol: ADAM2;
  Gene Name: ADAM metallopeptidase domain 2;
  ENSP ID: ENSP00000488853

SEQ ID NO: 2183 - protein, 776 aa, Homo sapiens
  Payload ID: 544;
  Gene Symbol: ADAM20;
  Gene Name: ADAM metallopeptidase domain 20;
  Uniprot ID:  O43506;
  ENSP ID: ENSP00000256389
MVQLHQDTDPQIPKGQPCTLNSSEGGARPAVPHTLFSSALDRWLHNDSFIMAVGEPLVHIRVTLLLLWFGMFLSISGHSQARPSQYFTSPEVVIPLKVISRGRGAKAPGWLSYSLRFGGQRYIVHMRVNKLLFAAHLPVFTYTEQHALLQDQPFIQDDCYYHGYVEGVPESLVALSTCSGGFLGMLQINDLVYEIKPISVSATFEHLVYKIDSDDTQFPPMRCGLTEEKIAHQMELQLSYNFTLKQSSFVGWWTHQRFVELVVVVDNIRYLFSQSNATTVQHEVFNVVNIVDSFYHPLEVDVILTGIDIWTASNPLPTSGDLDNVLEDFSIWKNYNLNNRLQHDVAHLFIKDTQGMKLGVAYVKGICQNPFNTGVDVFEDNRLVVFAITLGHELGHNLGMQHDTQWCVCELQWCIMHAYRKVTTKFSNCSYAQYWDSTISSGLCIQPPPYPGNIFRLKYCGNLVVEEGEECDCGTIRQCAKDPCCLLNCTLHPGAACAFGICCKDCKFLPSGTLCRQQVGECDLPEWCNGTSHQCPDDVYVQDGISCNVNAFCYEKTCNNHDIQCKEIFGQDARSASQSCYQEINTQGNRFGHCGIVGTTYVKCWTPDIMCGRVQCENVGVIPNLIEHSTVQQFHLNDTTCWGTDYHLGMAIPDIGEVKDGTVCGPEKICIRKKCASMVHLSQACQPKTCNMRGICNNKQHCHCNHEWAPPYCKDKGYGGSADSGPPPKNNMEGLNVMGKLRYLSLLCLLPLVAFLLFCLHVLFKKRTKSKEDEEG

SEQ ID NO: 2184 - protein, 722 aa, Homo sapiens
  Payload ID: 545;
  Gene Symbol: ADAM21;
  Gene Name: ADAM metallopeptidase domain 21;
  Uniprot ID:  Q9UKJ8;
  ENSP ID: ENSP00000474385
MAVDGTLVYIRVTLLLLWLGVFLSISGYCQAGPSQHFTSPEVVIPLKVISRGRSAKAPGWLSYSLRFGGQKHVVHMRVKKLLVSRHLPVFTYTDDRALLEDQLFIPDDCYYHGYVEAAPESLVVFSACFGGFRGVLKISGLTYEIEPIRHSATFEHLVYKINSNETQFPAMRCGLTEKEVARQQLEFEEAENSALEPKSAGDWWTHAWFLELVVVVNHDFFIYSQSNISKVQEDVFLVVNIVDSMYKQLGTYIILIGIEIWNQGNVFPMTSIEQVLNDFSQWKQISLSQLQHDAAHMFIKNSLISILGLAYVAGICRPPIDCGVDNFQGDTWSLFANTVAHELGHTLGMQHDEEFCFCGERGCIMNTFRVPAEKFTNCSYADFMKTTLNQGSCLHNPPRLGEIFMLKRCGNGVVEREEQCDCGSVQQCEQDACCLLNCTLRPGAACAFGLCCKDCKFMPSGELCRQEVNECDLPEWCNGTSHQCPEDRYVQDGIPCSDSAYCYQKRCNNHDQHCREIFGKDAKSASQNCYKEINSQGNRFGHCGINGTTYLKCHISDVFCGRVQCENVRDIPLLQDHFTLQHTHINGVTCWGIDYHLRMNISDIGEVKDGTVCGPGKICIHKKCVSLSVLSHVCLPETCNMKGICNNKHHCHCGYGWSPPYCQHRGYGGSIDSGPASAKRGVFLPLIVIPSLSVLTFLFTVGLLMYLRQCSGPKETKAHSSG

SEQ ID NO: 2185 - protein, 906 aa, Homo sapiens
  Payload ID: 546;
  Gene Symbol: ADAM22;
  Gene Name: ADAM metallopeptidase domain 22;
  Uniprot ID:  Q9P0K1;
  ENSP ID: ENSP00000265727
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 2186 - protein, 859 aa, Homo sapiens
  Payload ID: 546;
  Gene Symbol: ADAM22;
  Gene Name: ADAM metallopeptidase domain 22;
  Uniprot ID:  Q9P0K1;
  ENSP ID: ENSP00000381260
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQGNLGGNKKKIRGKRFRPRSNSTE

SEQ ID NO: 2187 - protein, 804 aa, Homo sapiens
  Payload ID: 546;
  Gene Symbol: ADAM22;
  Gene Name: ADAM metallopeptidase domain 22;
  ENSP ID: ENSP00000381261
MELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQG

SEQ ID NO: 2188 - protein, 870 aa, Homo sapiens
  Payload ID: 546;
  Gene Symbol: ADAM22;
  Gene Name: ADAM metallopeptidase domain 22;
  Uniprot ID:  Q9P0K1;
  ENSP ID: ENSP00000381262
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 2189 - protein, 899 aa, Homo sapiens
  Payload ID: 546;
  Gene Symbol: ADAM22;
  Gene Name: ADAM metallopeptidase domain 22;
  Uniprot ID:  Q9P0K1;
  ENSP ID: ENSP00000381267
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRSNGLSHSWSERIPDTKHISDICENGRPRSNSWQGNLGGNKKKIRGKRFRPRSNSTEYLNPWFKRDYNVAKWVEDVNKNTEGPYFRTLSPAKSPSSSTGSIASSRKYPYPMPPLPDEDKKVNRQSARLWETSI

SEQ ID NO: 2190 - protein, 342 aa, Homo sapiens
  Payload ID: 546;
  Gene Symbol: ADAM22;
  Gene Name: ADAM metallopeptidase domain 22;
  ENSP ID: ENSP00000391334
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSYVTSVMMYYFF

SEQ ID NO: 2191 - protein, 330 aa, Homo sapiens
  Payload ID: 546;
  Gene Symbol: ADAM22;
  Gene Name: ADAM metallopeptidase domain 22;
  ENSP ID: ENSP00000396233
EEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQGNLGGNKKKIRGKRFRPRSNSTEREPQAPEPGHSLAQTVPSQGISPGGSDSPQTGSLDHRYLNPWFKRDYNVAKWVEDVNKNTEGPYFRTLSPAKSPSSSTGSIASSRKYPYPMPPLPDEDKKVNRQSARLWETSI

SEQ ID NO: 2192 - protein, 264 aa, Homo sapiens
  Payload ID: 546;
  Gene Symbol: ADAM22;
  Gene Name: ADAM metallopeptidase domain 22;
  ENSP ID: ENSP00000412085
  MOD_RES (1)..(1): Any amino acid
XCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSAFLSHFQISTCSITHYSISQNISLFCSRSNGLSHSWSERIPDTKHISDICENGRPRSNSWQGNLGGNKKKIRGKRFRPRSNSTEYLNPWFKRDYNVAKWVEDVNKNTEGPYFRTLSPAKSPSSSTGSIASSRKYPYPMPPLPDEDKKVNRQSARLWETSI

SEQ ID NO: 2193 - protein, 196 aa, Homo sapiens
  Payload ID: 546;
  Gene Symbol: ADAM22;
  Gene Name: ADAM metallopeptidase domain 22;
  ENSP ID: ENSP00000413899
MQAAVAVSVPFLLLCVLGTCPPARCGQAGDASLMELEKRKENRFVERQSIVPLRLIYRSGGEDESRHDALDTRVRGDLGGPQIQMFLKSESQKTIYQIQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQ

SEQ ID NO: 2194 - protein, 832 aa, Homo sapiens
  Payload ID: 547;
  Gene Symbol: ADAM23;
  Gene Name: ADAM metallopeptidase domain 23;
  Uniprot ID:  O75077;
  ENSP ID: ENSP00000264377
MKPPGSSSRQPPLAGCSLAGASCGPQRGPAGSVPASAPARTPPCRLLLVLLLLPPLAASSRPRAWGAAAPSAPHWNETAEKNLGVLADEDNTLQQNSSSNISYSNAMQKEITLPSRLIYYINQDSESPYHVLDTKARHQQKHNKAVHLAQASFQIEAFGSKFILDLILNNGLLSSDYVEIHYENGKPQYSKGGEHCYYHGSIRGVKDSKVALSTCNGLHGMFEDDTFVYMIEPLELVHDEKSTGRPHIIQKTLAGQYSKQMKNLTMERGDQWPFLSELQWLKRRKRAVNPSRGIFEEMKYLELMIVNDHKTYKKHRSSHAHTNNFAKSVVNLVDSIYKEQLNTRVVLVAVETWTEKDQIDITTNPVQMLHEFSKYRQRIKQHADAVHLISRVTFHYKRSSLSYFGGVCSRTRGVGVNEYGLPMAVAQVLSQSLAQNLGIQWEPSSRKPKCDCTESWGGCIMEETGVSHSRKFSKCSILEYRDFLQRGGGACLFNRPTKLFEPTECGNGYVEAGEECDCGFHVECYGLCCKKCSLSNGAHCSDGPCCNNTSCLFQPRGYECRDAVNECDITEYCTGDSGQCPPNLHKQDGYACNQNQGRCYNGECKTRDNQCQYIWGTKAAGSDKFCYEKLNTEGTEKGNCGKDGDRWIQCSKHDVFCGFLLCTNLTRAPRIGQLQGEIIPTSFYHQGRVIDCSGAHVVLDDDTDVGYVEDGTPCGPSMMCLDRKCLQIQALNMSSCPLDSKGKVCSGHGVCSNEATCICDFTWAGTDCSIRDPVRNLHPPKDEGPKGPSATNLIIGSIAGAILVAAIVLGGTGWGFKNVKKRRFDPTQQGPI

SEQ ID NO: 2195 - protein, 832 aa, Homo sapiens
  Payload ID: 547;
  Gene Symbol: ADAM23;
  Gene Name: ADAM metallopeptidase domain 23;
  ENSP ID: ENSP00000363536
MKPPGSSSRQPPLAGCSLAGASCGPQRGPAGSVPASAPARTPPCRLLLVLLLLPPLAASSRPRAWGAAAPSAPHWNETAEKNLGVLADEDNTLQQNSSSNISYSNAMQKEITLPSRLIYYINQDSESPYHVLDTKARHQQKHNKAVHLAQASFQIEAFGSKFILDLILNNGLLSSDYVEIHYENGKPQYSKGGEHCYYHGSIRGVKDSKVALSTCNGLHGMFEDDTFVYMIEPLELVHDEKSTGRPHIIQKTLAGQYSKQMKNLTMERGDQWPFLSELQWLKRRKRAVNPSRGIFEEMKYLELMIVNDHKTYKKHRSSHAHTNNFAKSVVNLVDSIYKEQLNTRVVLVAVETWTEKDQIDITTNPVQMLHEFSKYRQRIKQHADAVHLISRVTFHYKRSSLSYFGGVCSRTRGVGVNEYGLPMAVAQVLSQSLAQNLGIQWEPSSRKPKCDCTESWGGCIMEETGVSHSRKFSKCSILEYRDFLQRGGGACLFNRPTKLFEPTECGNGYVEAGEECDCGFHVECYGLCCKKCSLSNGAHCSDGPCCNNTSCLFQPRGYECRDAVNECDITEYCTGDSGQCPPNLHKQDGYACNQNQGRCYNGECKTRDNQCQYIWGTKAAGSDKFCYEKLNTEGTEKGNCGKDGDRWIQCSKHDVFCGFLLCTNLTRAPRIGQLQGEIIPTSFYHQGRVIDCSGAHVVLDDDTDVGYVEDGTPCGPSMMCLDRKCLQIQALNMSSCPLDSKGKVCSGHGVCSNEATCICDFTWAGTDCSIRDPVRNLHPPKDEGPKVNMATSRLIGAVAGTILALGVIFGGTGWGIENVKKRRFDPTQQGPI

SEQ ID NO: 2196 - protein, 107 aa, Homo sapiens
  Payload ID: 547;
  Gene Symbol: ADAM23;
  Gene Name: ADAM metallopeptidase domain 23;
  ENSP ID: ENSP00000406827
  MOD_RES (1)..(1): Any amino acid
XQIQALNMSSCPLDSKGKVCSGHGVCSNEATCICDFTWAGTDCSIRDPVRNLHPPKDEGPKEMSRREGSILLSKAPSESAALDGHRLALLDSGYDILAAVLLELLSL

SEQ ID NO: 2197 - protein, 775 aa, Homo sapiens
  Payload ID: 548;
  Gene Symbol: ADAM28;
  Gene Name: ADAM metallopeptidase domain 28;
  Uniprot ID:  Q9UKQ2;
  ENSP ID: ENSP00000265769
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEMSQMKPHVYDLPVEGNEPPASFHKDTNALPPTVFKDNPVSTPKDSNPKA

SEQ ID NO: 2198 - protein, 540 aa, Homo sapiens
  Payload ID: 548;
  Gene Symbol: ADAM28;
  Gene Name: ADAM metallopeptidase domain 28;
  Uniprot ID:  Q9UKQ2;
  ENSP ID: ENSP00000393699
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGRRTNPFPCACAKENHFR

SEQ ID NO: 2199 - protein, 387 aa, Homo sapiens
  Payload ID: 548;
  Gene Symbol: ADAM28;
  Gene Name: ADAM metallopeptidase domain 28;
  ENSP ID: ENSP00000429484
  MOD_RES (1)..(1): Any amino acid
XFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEMSQMKPHVYDLPVEGNEPPASFDSNPKA

SEQ ID NO: 2200 - protein, 217 aa, Homo sapiens
  Payload ID: 548;
  Gene Symbol: ADAM28;
  Gene Name: ADAM metallopeptidase domain 28;
  ENSP ID: ENSP00000430085
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEF

SEQ ID NO: 2201 - protein, 174 aa, Homo sapiens
  Payload ID: 548;
  Gene Symbol: ADAM28;
  Gene Name: ADAM metallopeptidase domain 28;
  ENSP ID: ENSP00000430094
  MOD_RES (1)..(1): Any amino acid
XKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEVNYIVWAVITMAPLCVSLTLLS

SEQ ID NO: 2202 - protein, 58 aa, Homo sapiens
  Payload ID: 548;
  Gene Symbol: ADAM28;
  Gene Name: ADAM metallopeptidase domain 28;
  ENSP ID: ENSP00000431108
MLQGLLPVSLLLSVAVSAIKELPGVKKYEVVYPIRLHPLHKREAKEPEQQFLSSMKIS

SEQ ID NO: 2203 - protein, 820 aa, Homo sapiens
  Payload ID: 549;
  Gene Symbol: ADAM29;
  Gene Name: ADAM metallopeptidase domain 29;
  Uniprot ID:  Q9UKF5;
  ENSP ID: ENSP00000352177
MKMLLLLHCLGVFLSCSGHIQDEHPQYHSPPDVVIPVRITGTTRGMTPPGWLSYILPFGGQKHIIHIKVKKLLFSKHLPVFTYTDQGAILEDQPFVQNNCYYHGYVEGDPESLVSLSTCFGGFQGILQINDFAYEIKPLAFSTTFEHLVYKMDSEEKQFSTMRSGFMQNEITCRMEFEEIDNSTQKQSSYVGWWIHFRIVEIVVVIDNYLYIRYERNDSKLLEDLYVIVNIVDSILDVIGVKVLLFGLEIWTNKNLIVVDDVRKSVHLYCKWKSENITPRMQHDTSHLFTTLGLRGLSGIGAFRGMCTPHRSCAIVTFMNKTLGTFSIAVAHHLGHNLGMNHDEDTCRCSQPRCIMHEGNPPITKFSNCSYGDFWEYTVERTKCLLETVHTKDIFNVKRCGNGVVEEGEECDCGPLKHCAKDPCCLSNCTLTDGSTCAFGLCCKDCKFLPSGKVCRKEVNECDLPEWCNGTSHKCPDDFYVEDGIPCKERGYCYEKSCHDRNEQCRRIFGAGANTASETCYKELNTLGDRVGHCGIKNATYIKCNISDVQCGRIQCENVTEIPNMSDHTTVHWARFNDIMCWSTDYHLGMKGPDIGEVKDGTECGIDHICIHRHCVHITILNSNCSPAFCNKRGICNNKHHCHCNYLWDPPNCLIKGYGGSVDSGPPPKRKKKKKFCYLCILLLIVLFILLCCLYRLCKKSKPIKKQQDVQTPSAKEEEKIQRRPHELPPQSQPWVMPSQSQPPVTPSQSHPQVMPSQSQPPVTPSQSQPRVMPSQSQPPVMPSQSHPQLTPSQSQPPVTPSQRQPQLMPSQSQPPVTPS

SEQ ID NO: 2204 - protein, 820 aa, Homo sapiens; identical to SEQ ID NO: 2203
  Payload ID: 549;
  Gene Symbol: ADAM29;
  Gene Name: ADAM metallopeptidase domain 29;
  Uniprot ID:  Q9UKF5;
  ENSP ID: ENSP00000384229

SEQ ID NO: 2205 - protein, 820 aa, Homo sapiens; identical to SEQ ID NO: 2203
  Payload ID: 549;
  Gene Symbol: ADAM29;
  Gene Name: ADAM metallopeptidase domain 29;
  Uniprot ID:  Q9UKF5;
  ENSP ID: ENSP00000414544

SEQ ID NO: 2206 - protein, 44 aa, Homo sapiens
  Payload ID: 549;
  Gene Symbol: ADAM29;
  Gene Name: ADAM metallopeptidase domain 29;
  ENSP ID: ENSP00000422537
MKMLLLLHCLGVFLSCSGHIQDEHPQYHSPPDVVIPVRITGTTR

SEQ ID NO: 2207 - protein, 820 aa, Homo sapiens; identical to SEQ ID NO: 2203
  Payload ID: 549;
  Gene Symbol: ADAM29;
  Gene Name: ADAM metallopeptidase domain 29;
  Uniprot ID:  Q9UKF5;
  ENSP ID: ENSP00000423517

SEQ ID NO: 2208 - protein, 14 aa, Homo sapiens
  Payload ID: 549;
  Gene Symbol: ADAM29;
  Gene Name: ADAM metallopeptidase domain 29;
  ENSP ID: ENSP00000427370
MKMLLLLHCLGVFL

SEQ ID NO: 2209 - protein, 89 aa, Homo sapiens
  Payload ID: 549;
  Gene Symbol: ADAM29;
  Gene Name: ADAM metallopeptidase domain 29;
  ENSP ID: ENSP00000427674
MKMLLLLHCLGVFLSCSGHIQDEHPQYHSPPDVVIPVRITGTTRGMTPPGWLSYILPFGGQKHIIHIKVKKLLFSKHLPVFTYTDQGAI

SEQ ID NO: 2210 - protein, 820 aa, Homo sapiens; identical to SEQ ID NO: 2203
  Payload ID: 549;
  Gene Symbol: ADAM29;
  Gene Name: ADAM metallopeptidase domain 29;
  Uniprot ID:  Q9UKF5;
  ENSP ID: ENSP00000478469

SEQ ID NO: 2211 - protein, 820 aa, Homo sapiens; identical to SEQ ID NO: 2203
  Payload ID: 549;
  Gene Symbol: ADAM29;
  Gene Name: ADAM metallopeptidase domain 29;
  Uniprot ID:  Q9UKF5;
  ENSP ID: ENSP00000484862

SEQ ID NO: 2212 - protein, 790 aa, Homo sapiens
  Payload ID: 550;
  Gene Symbol: ADAM30;
  Gene Name: ADAM metallopeptidase domain 30;
  Uniprot ID:  Q9UKF2;
  ENSP ID: ENSP00000358407
MRSVQIFLSQCRLLLLLVPTMLLKSLGEDVIFHPEGEFDSYEVTIPEKLSFRGEVQGVVSPVSYLLQLKGKKHVLHLWPKRLLLPRHLRVFSFTEHGELLEDHPYIPKDCNYMGSVKESLDSKATISTCMGGLRGVFNIDAKHYQIEPLKASPSFEHVVYLLKKEQFGNQVCGLSDDEIEWQMAPYENKARLRDFPGSYKHPKYLELILLFDQSRYRFVNNNLSQVIHDAILLTGIMDTYFQDVRMRIHLKALEVWTDFNKIRVGYPELAEVLGRFVIYKKSVLNARLSSDWAHLYLQRKYNDALAWSFGKVCSLEYAGSVSTLLDTNILAPATWSAHELGHAVGMSHDEQYCQCRGRLNCIMGSGRTGFSNCSYISFFKHISSGATCLNNIPGLGYVLKRCGNKIVEDNEECDCGSTEECQKDRCCQSNCKLQPGANCSIGLCCHDCRFRPSGYVCRQEGNECDLAEYCDGNSSSCPNDVYKQDGTPCKYEGRCFRKGCRSRYMQCQSIFGPDAMEAPSECYDAVNLIGDQFGNCEITGIRNFKKCESANSICGRLQCINVETIPDLPEHTTIISTHLQAENLMCWGTGYHLSMKPMGIPDLGMINDGTSCGEGRVCFKKNCVNSSVLQFDCLPEKCNTRGVCNNRKNCHCMYGWAPPFCEEVGYGGSIDSGPPGLLRGAIPSSIWVVSIIMFRLILLILSVVFVFFRQVIGNHLKPKQEKMPLSKAKTEQEESKTKTVQEESKTKTGQEESEAKTGQEESKAKTGQEESKANIESKRPKAKSVKKQKK

SEQ ID NO: 2213 - protein, 787 aa, Homo sapiens
  Payload ID: 551;
  Gene Symbol: ADAM32;
  Gene Name: ADAM metallopeptidase domain 32;
  Uniprot ID:  Q8TC27;
  ENSP ID: ENSP00000369238
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLYDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALYPKEITLEAFAVIVTQMLALSLGISYDDPKKCQCSESTCIMNPEVVQSNGVKTFSSCSLRSFQNFISNVGVKCLQNKPQMQKKSPKPVCGNGRLEGNEICDCGTEAQCGPASCCDFRTCVLKDGAKCYKGLCCKDCQILQSGVECRPKAHPECDIAENCNGTSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSEGSTQTYASQSSSEGSTQTYASQTRSESSSQADTSKSKSEDSAEAYTSRSKSQDSTQTQSSSN

SEQ ID NO: 2214 - protein, 155 aa, Homo sapiens
  Payload ID: 551;
  Gene Symbol: ADAM32;
  Gene Name: ADAM metallopeptidase domain 32;
  ENSP ID: ENSP00000382727
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRSLKEQPMDDNIFISEKSEPAVPDLFPLYLEMHIVVDK

SEQ ID NO: 2215 - protein, 688 aa, Homo sapiens
  Payload ID: 551;
  Gene Symbol: ADAM32;
  Gene Name: ADAM metallopeptidase domain 32;
  ENSP ID: ENSP00000405978
MNVRGAAPGVRASPRPWQFPTSQRLPAGSPEAAPCSASGCCWPGSAASWRQDPEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLYDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALQCGPASCCDFRTCVLKDGAKCYKGLCCKDCQILQSGVECRPKAHPECDIAENCNGTSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSEGSTQTYASQSSSEGSTQTYASQTRSESSSQADTSKSKSEDSAEAYTSRSKSQDSTQTQSSSN

SEQ ID NO: 2216 - protein, 172 aa, Homo sapiens
  Payload ID: 551;
  Gene Symbol: ADAM32;
  Gene Name: ADAM metallopeptidase domain 32;
  ENSP ID: ENSP00000427735
MQLALFKNMKSWHFILKSGSLFPSLECSHIWLNSFEKILETGLANMNIYLGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQH

SEQ ID NO: 2217 - protein, 184 aa, Homo sapiens
  Payload ID: 551;
  Gene Symbol: ADAM32;
  Gene Name: ADAM metallopeptidase domain 32;
  ENSP ID: ENSP00000429066
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKYDYWGSDSM

SEQ ID NO: 2218 - protein, 629 aa, Homo sapiens
  Payload ID: 551;
  Gene Symbol: ADAM32;
  Gene Name: ADAM metallopeptidase domain 32;
  ENSP ID: ENSP00000429422
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLYDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALQCGPASCCDFRTCVLKDGAKCYKGLCCKDCQILQSGVECRPKAHPECDIAENCNGTSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSQDSTQTQSSSN

SEQ ID NO: 2219 - protein, 53 aa, Homo sapiens
  Payload ID: 551;
  Gene Symbol: ADAM32;
  Gene Name: ADAM metallopeptidase domain 32;
  ENSP ID: ENSP00000431050
MIYLYNQGSMNTYSSDIQTQCYYQGNIEGYPDSMVTLSTCSGLRGILQFENVS

SEQ ID NO: 2220 - protein, 629 aa, Homo sapiens
  Payload ID: 551;
  Gene Symbol: ADAM32;
  Gene Name: ADAM metallopeptidase domain 32;
  ENSP ID: ENSP00000483377
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLYDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALQCGPASCCDFRTCVLKDGAKCYKGLCCKDCQILQSGVECRPKAHPECDIAENCNGSSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSQDSTQTQSSSN

SEQ ID NO: 2221 - protein, 787 aa, Homo sapiens
  Payload ID: 551;
  Gene Symbol: ADAM32;
  Gene Name: ADAM metallopeptidase domain 32;
  Uniprot ID:  Q8TC27;
  ENSP ID: ENSP00000484817
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLYDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALYPKEITLEAFAVIVTQMLALSLGISYDDPKKCQCSESTCIMNPEVVQSNGVKTFSSCSLRSFQNFISNVGVKCLQNKPQMQKKSPKPVCGNGRLEGNEICDCGTEAQCGPASCCDFRTCVLKDGAKCYKGLCCKDCQILQSGVECRPKAHPECDIAENCNGSSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSEGSTQTYASQSSSEGSTQTYASQTRSESSSQADTSKSKSEDSAEAYTSRSKSQDSTQTQSSSN

SEQ ID NO: 2222 - protein, 155 aa, Homo sapiens; identical to SEQ ID NO: 2214
  Payload ID: 551;
  Gene Symbol: ADAM32;
  Gene Name: ADAM metallopeptidase domain 32;
  ENSP ID: ENSP00000487692

SEQ ID NO: 2223 - protein, 53 aa, Homo sapiens; identical to SEQ ID NO: 2219
  Payload ID: 551;
  Gene Symbol: ADAM32;
  Gene Name: ADAM metallopeptidase domain 32;
  ENSP ID: ENSP00000487983

SEQ ID NO: 2224 - protein, 54 aa, Homo sapiens
  Payload ID: 551;
  Gene Symbol: ADAM32;
  Gene Name: ADAM metallopeptidase domain 32;
  ENSP ID: ENSP00000488048
  MOD_RES (1)..(1): Any amino acid
XSKSEGSTQTYASQSSSEGSTQTYASQTRSESSSQADTSKSKSQDSTQTQSSSN

SEQ ID NO: 2225 - protein, 688 aa, Homo sapiens
  Payload ID: 551;
  Gene Symbol: ADAM32;
  Gene Name: ADAM metallopeptidase domain 32;
  ENSP ID: ENSP00000488417
MNVRGAAPGVRASPRPWQFPTSQRLPAGSPEAAPCSASGCCWPGSAASWRQDPEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLYDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALQCGPASCCDFRTCVLKDGAKCYKGLCCKDCQILQSGVECRPKAHPECDIAENCNGSSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSEGSTQTYASQSSSEGSTQTYASQTRSESSSQADTSKSKSEDSAEAYTSRSKSQDSTQTQSSSN

SEQ ID NO: 2226 - protein, 172 aa, Homo sapiens; identical to SEQ ID NO: 2216
  Payload ID: 551;
  Gene Symbol: ADAM32;
  Gene Name: ADAM metallopeptidase domain 32;
  ENSP ID: ENSP00000488605

SEQ ID NO: 2227 - protein, 184 aa, Homo sapiens; identical to SEQ ID NO: 2217
  Payload ID: 551;
  Gene Symbol: ADAM32;
  Gene Name: ADAM metallopeptidase domain 32;
  ENSP ID: ENSP00000488698

SEQ ID NO: 2228 - protein, 787 aa, Homo sapiens
  Payload ID: 552;
  Gene Symbol: ADAM33;
  Gene Name: ADAM metallopeptidase domain 33;
  Uniprot ID:  Q9BZ11;
  ENSP ID: ENSP00000322550
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRVTQDANATLWAFLQWRRGLWAQRPHDSAQLLTGRAFQGATVGLAPVEGMCRAESSGGVSTDHSELPIGAAATMAHEIGHSLGLSHDPDGCCVEAAAESGGCVMAAATGHPFPRVFSACSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQADQVQMPRSCLW

SEQ ID NO: 2229 - protein, 813 aa, Homo sapiens
  Payload ID: 552;
  Gene Symbol: ADAM33;
  Gene Name: ADAM metallopeptidase domain 33;
  Uniprot ID:  Q9BZ11;
  ENSP ID: ENSP00000348912
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRVTQDANATLWAFLQWRRGLWAQRPHDSAQLLTGRAFQGATVGLAPVEGMCRAESSGGVSTDHSELPIGAAATMAHEIGHSLGLSHDPDGCCVEAAAESGGCVMAAATGHPFPRVFSACSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQADQVQMPRSCLW

SEQ ID NO: 2230 - protein, 812 aa, Homo sapiens
  Payload ID: 552;
  Gene Symbol: ADAM33;
  Gene Name: ADAM metallopeptidase domain 33;
  ENSP ID: ENSP00000369190
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRVTQDANATLWAFLQWRRGLWAQRPHDSAQLLTGRAFQGATVGLAPVEGMCRAESSGGVSTDHSELPIGAAATMAHEIGHSLGLSHDPDGCCVEAAAESGGCVMAAATGHPFPRVFSACSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQDQVQMPRSCLW

SEQ ID NO: 2231 - protein, 138 aa, Homo sapiens
  Payload ID: 552;
  Gene Symbol: ADAM33;
  Gene Name: ADAM metallopeptidase domain 33;
  ENSP ID: ENSP00000483343
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTVRCFHGLWDAPPEVPPHHSYPYSSLHS

SEQ ID NO: 2232 - protein, 692 aa, Homo sapiens
  Payload ID: 552;
  Gene Symbol: ADAM33;
  Gene Name: ADAM metallopeptidase domain 33;
  ENSP ID: ENSP00000484600
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQDQVQMPRSCLW

SEQ ID NO: 2233 - protein, 754 aa, Homo sapiens
  Payload ID: 553;
  Gene Symbol: ADAM7;
  Gene Name: ADAM metallopeptidase domain 7;
  Uniprot ID:  Q9H2U9;
  ENSP ID: ENSP00000175238
MLPGCIFLMILLIPQVKEKFILGVEGQQLVRPKKLPLIQKRDTGHTHDDDILKTYEEELLYEIKLNRKTLVLHLLRSREFLGSNYSETFYSMKGEAFTRHPQIMDHCFYQGSIVHEYDSAASISTCNGLRGFFRINDQRYLIEPVKYSDEGEHLVFKYNLRVPYGANYSCTELNFTRKTVPGDNESEEDSKIKGIHDEKYVELFIVADDTVYRRNGHPHNKLRNRIWGMVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLNKPASKDSRGIADPNQSAK

SEQ ID NO: 2234 - protein, 776 aa, Homo sapiens
  Payload ID: 553;
  Gene Symbol: ADAM7;
  Gene Name: ADAM metallopeptidase domain 7;
  ENSP ID: ENSP00000370166
MLPGCIFLMILLIPQVKEKFILGVEGQQLVRPKKLPLIQKRDTGHTHDDDILKTYEEELLYEIKLNRKTLVLHLLRSREFLGSNYSETFYSMKGEAFTRHPQIMDHCFYQGSIVHEYDSAASISTCNGLRGFFRINDQRYLIEPVKYSDEGEHLVFKYNLRVPYGANYSCTELNFTRKTVPGDNESEEDSKIKGIHDEKYVELFIVADDTVYRRNGHPHNKLRNRIWGMVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLNQRTPESLESLPTSFSSPHYITLKPASKDSRGIADPNQSAK

SEQ ID NO: 2235 - protein, 210 aa, Homo sapiens
  Payload ID: 553;
  Gene Symbol: ADAM7;
  Gene Name: ADAM metallopeptidase domain 7;
  Uniprot ID:  Q9H2U9;
  ENSP ID: ENSP00000393073
MLPGCIFLMILLIPQVKEKFILGVEGQQLVRPKKLPLIQKRDTGHTHDDDILKTYEEELLYEIKLNRKTLVLHLLRSREFLGSNYSETFYSMKGEAFTRHPQIMDHCFYQGSIVHEYDSAASISTCNGLRGFFRINDQRYLIEPVKYSDEGEHLVFKYNLRVPYGANYSCTELNFTRKTVPGDNESEEDSKIKVSTLLLSLPQMKHLLFS

SEQ ID NO: 2236 - protein, 516 aa, Homo sapiens
  Payload ID: 553;
  Gene Symbol: ADAM7;
  Gene Name: ADAM metallopeptidase domain 7;
  ENSP ID: ENSP00000430400
MVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLNHLLYGRHQ

SEQ ID NO: 2237 - protein, 109 aa, Homo sapiens
  Payload ID: 554;
  Gene Symbol: ADAM8;
  Gene Name: ADAM metallopeptidase domain 8;
  ENSP ID: ENSP00000452994
MRGLGLWLLGAMMLPGPAPREGELRPWGHRAQLHPPPAEEQGPAGLRLHRDLYGCQWLRGDGAASRAGPLLLPGPRRGVPGLSRQPQHLCRPQGFLPGGVRPAPDRAPG

SEQ ID NO: 2238 - protein, 733 aa, Homo sapiens
  Payload ID: 554;
  Gene Symbol: ADAM8;
  Gene Name: ADAM metallopeptidase domain 8;
  Uniprot ID:  P78325;
  ENSP ID: ENSP00000453043
MRGLGLWLLGAMMLPGPAPREGELRPWGHRAQLHPPPAEEQGPAGLRLHRDLYGCQWLRGDGAASRAGPLLLPGPRRGVPGLSRQPQHLCRPQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCNHKQECHCHAGWAPPHCAKLLTEVHAASGSLPVFVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQGAVGPKVALKPPIQRKQGAGAPTAP

SEQ ID NO: 2239 - protein, 824 aa, Homo sapiens
  Payload ID: 554;
  Gene Symbol: ADAM8;
  Gene Name: ADAM metallopeptidase domain 8;
  Uniprot ID:  P78325;
  ENSP ID: ENSP00000453302
MRGLGLWLLGAMMLPAIAPSRPWALMEQYEVVLPWRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVFVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 2240 - protein, 245 aa, Homo sapiens
  Payload ID: 554;
  Gene Symbol: ADAM8;
  Gene Name: ADAM metallopeptidase domain 8;
  ENSP ID: ENSP00000453735
MRGLGLWLLGAMMLPAIAPSRPWALMEQYEVVLPWRLPGPRVRRALPSHLGGQFRPQPCPYLSIRGTYYRPARCPGLIQPVAQLRLSQSSAGRAPACTWGLEMQWSSRRLCRHHQGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGP

SEQ ID NO: 2241 - protein, 742 aa, Homo sapiens
  Payload ID: 554;
  Gene Symbol: ADAM8;
  Gene Name: ADAM metallopeptidase domain 8;
  Uniprot ID:  P78325;
  ENSP ID: ENSP00000453855
MRGLGLWLLGAMMLPAIAPSRPWALMEQYEVVLPWRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAGCQPRAGQGRGSSPIQGPPRAGPHHPPGPARPTPGLLGGSEEAAPCSSGHCVQPTLPSSCLHPAGTKAGHQANVRTPSAPSQTRGWCGQPWSS

SEQ ID NO: 2242 - protein, 655 aa, Homo sapiens
  Payload ID: 555;
  Gene Symbol: ADAM9;
  Gene Name: ADAM metallopeptidase domain 9;
  Uniprot ID:  Q13443;
  ENSP ID: ENSP00000369249
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGK

SEQ ID NO: 2243 - protein, 128 aa, Homo sapiens
  Payload ID: 555;
  Gene Symbol: ADAM9;
  Gene Name: ADAM metallopeptidase domain 9;
  ENSP ID: ENSP00000417066
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQVMYFSLDPIANFKTIII

SEQ ID NO: 2244 - protein, 712 aa, Homo sapiens
  Payload ID: 555;
  Gene Symbol: ADAM9;
  Gene Name: ADAM metallopeptidase domain 9;
  ENSP ID: ENSP00000418437
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNGQMAKIKQTLLDSRGVFLDMFLQ

SEQ ID NO: 2245 - protein, 628 aa, Homo sapiens
  Payload ID: 555;
  Gene Symbol: ADAM9;
  Gene Name: ADAM metallopeptidase domain 9;
  ENSP ID: ENSP00000418737
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKK

SEQ ID NO: 2246 - protein, 819 aa, Homo sapiens
  Payload ID: 555;
  Gene Symbol: ADAM9;
  Gene Name: ADAM metallopeptidase domain 9;
  Uniprot ID:  Q13443;
  ENSP ID: ENSP00000419446
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 2247 - protein, 147 aa, Homo sapiens
  Payload ID: 555;
  Gene Symbol: ADAM9;
  Gene Name: ADAM metallopeptidase domain 9;
  ENSP ID: ENSP00000420257
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQRCGPLCIREQSTPGDRAGQNTQNNWQMSNLAFCVYY

SEQ ID NO: 2248 - protein, 53 aa, Homo sapiens
  Payload ID: 555;
  Gene Symbol: ADAM9;
  Gene Name: ADAM metallopeptidase domain 9;
  ENSP ID: ENSP00000488700
PIYANRFAVPTYAAKQPQQFPSRPPPPQPKVSSQGNLIPARPAPAPPLYSSLT

SEQ ID NO: 2249 - protein, 344 aa, Homo sapiens
  Payload ID: 556;
  Gene Symbol: ADAMTS13;
  Gene Name: ADAM metallopeptidase with thrombospondin type 1, motif 13;
  ENSP ID: ENSP00000485845
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLRPVPPSPLPLLATHLCAGRSLSLGPSQEPAPGGGRGPRTPVPTHKRPRFQTLPSSCPLLRPASSRCTPRD

SEQ ID NO: 2250 - protein, 1340 aa, Homo sapiens
  Payload ID: 556;
  Gene Symbol: ADAMTS13;
  Gene Name: ADAM metallopeptidase with thrombospondin type 1, motif 13;
  ENSP ID: ENSP00000485989
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVYRRYGEEYGNLTRPDITFTYFQPKPRQAWVWAAVRGPCSVSCGAGLRWVNYSCLDQARKELVETVQCQGSQQPPAWPEACVLEPCPPYWAVGDFGPCSASCGGGLRERPVRCVEAQGSLLKTLPPARCRAGAQQPAVALETCNPQPCPARWEVSEPSSCTSAGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 2251 - protein, 344 aa, Homo sapiens; identical to SEQ ID NO: 2249
  Payload ID: 556;
  Gene Symbol: ADAMTS13;
  Gene Name: ADAM metallopeptidase with thrombospondin type 1, motif 13;
  ENSP ID: ENSP00000486060

SEQ ID NO: 2252 - protein, 1427 aa, Homo sapiens
  Payload ID: 556;
  Gene Symbol: ADAMTS13;
  Gene Name: ADAM metallopeptidase with thrombospondin type 1, motif 13;
  ENSP ID: ENSP00000486201
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLSAGRARCVWDPPRPQPGSAGHPPDAQPGLYYSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVYRRYGEEYGNLTRPDITFTYFQPKPRQAWVWAAVRGPCSVSCGAGLRWVNYSCLDQARKELVETVQCQGSQQPPAWPEACVLEPCPPYWAVGDFGPCSASCGGGLRERPVRCVEAQGSLLKTLPPARCRAGAQQPAVALETCNPQPCPARWEVSEPSSCTSAGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGTPSLVPHEEAAAPGRTTATPAGASLEWSQARGLLFSPAPQPRRLLPGPQENSVQSSACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 2253 - protein, 276 aa, Homo sapiens
  Payload ID: 556;
  Gene Symbol: ADAMTS13;
  Gene Name: ADAM metallopeptidase with thrombospondin type 1, motif 13;
  ENSP ID: ENSP00000486371
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHRICARPSPATQTRWTKAAAAASSFLSWMGQNVAWRSGAPRVAAAPWWS

SEQ ID NO: 2254 - protein, 1371 aa, Homo sapiens
  Payload ID: 556;
  Gene Symbol: ADAMTS13;
  Gene Name: ADAM metallopeptidase with thrombospondin type 1, motif 13;
  ENSP ID: ENSP00000486734
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLSAGRARCVWDPPRPQPGSAGHPPDAQPGLYYSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVYRRYGEEYGNLTRPDITFTYFQPKPRQAWVWAAVRGPCSVSCGAGLRWVNYSCLDQARKELVETVQCQGSQQPPAWPEACVLEPCPPYWAVGDFGPCSASCGGGLRERPVRCVEAQGSLLKTLPPARCRAGAQQPAVALETCNPQPCPARWEVSEPSSCTSAGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 2255 - protein, 444 aa, Homo sapiens
  Payload ID: 556;
  Gene Symbol: ADAMTS13;
  Gene Name: ADAM metallopeptidase with thrombospondin type 1, motif 13;
  ENSP ID: ENSP00000487185
MASDGAAPRAGLAWSPCSRRQLLSLLSAGRARCVWDPPRPQPGSAGHPPDAQPGLYYSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVGGVRAQLMHISWWSRPGLGERDLCARGRWPGGSSD

SEQ ID NO: 2256 - protein, 223 aa, Homo sapiens
  Payload ID: 556;
  Gene Symbol: ADAMTS13;
  Gene Name: ADAM metallopeptidase with thrombospondin type 1, motif 13;
  ENSP ID: ENSP00000487509
MRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 2257 - protein, 967 aa, Homo sapiens
  Payload ID: 557;
  Gene Symbol: ADAMTS1;
  Gene Name: ADAM metallopeptidase with thrombospondin type 1 motif, 1;
  Uniprot ID:  Q9UHI8;
  ENSP ID: ENSP00000284984
MQRAVPEGFGRRKLGSDMGNAERAPGSRSFGPVPTLLLLAAALLAVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLATAAPGEKPPAPLQFHLLRRNRQGDVGGTCGVVDDEPRPTGKAETEDEDEGTEGEDEGAQWSPQDPALQGVGQPTGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 2258 - protein, 200 aa, Homo sapiens
  Payload ID: 557;
  Gene Symbol: ADAMTS1;
  Gene Name: ADAM metallopeptidase with thrombospondin type 1 motif, 1;
  ENSP ID: ENSP00000403404
  MOD_RES (1)..(1): Any amino acid
XCRSFLLRPSLCAVLILQFFLFHHFGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCA

SEQ ID NO: 2259 - protein, 171 aa, Homo sapiens
  Payload ID: 557;
  Gene Symbol: ADAMTS1;
  Gene Name: ADAM metallopeptidase with thrombospondin type 1 motif, 1;
  ENSP ID: ENSP00000429557
MLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASM

SEQ ID NO: 2260 - protein, 128 aa, Homo sapiens
  Payload ID: 557;
  Gene Symbol: ADAMTS1;
  Gene Name: ADAM metallopeptidase with thrombospondin type 1 motif, 1;
  ENSP ID: ENSP00000431065
MVTWEGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQT

SEQ ID NO: 2261 - protein, 1103 aa, Homo sapiens
  Payload ID: 558;
  Gene Symbol: ADAMTS10;
  Gene Name: ADAM metallopeptidase with thrombospondin type 1 motif, 10;
  ENSP ID: ENSP00000270328
MAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASSSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVAKLFQDSSLGSTVNILVTRLILLTEDQPTLEITHHAGKSLDSFCKWQKSIVNHSGHGNAIPENGVANHDTAVLITRYDICIYKNKPCGTLGLAPVGGMCERERSCSVNEDIGLATAFTIAHEIGHTFGMNHDGVGNSCGARGQDPAKLMAAHITMKTNPFVWSSCSRDYITSFLDSGLGLCLNNRPPRQDFVYPTVAPGQAYDADEQCRFQHGVKSRQCKYGEVCSELWCLSKSNRCITNSIPAAEGTLCQTHTIDKGWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEECKDVNKVAYCPLVLKFQFCSRAYFRQMCCKTCHGH

SEQ ID NO: 2262 - protein, 126 aa, Homo sapiens
  Payload ID: 558;
  Gene Symbol: ADAMTS10;
  Gene Name: ADAM metallopeptidase with thrombospondin type 1 motif, 10;
  ENSP ID: ENSP00000469516
MGPTSVLRAGLTPSCLPPPSGATNGSVSPLGRAQRVWTEPGGRGLHGATAAGPVAAACPLLAVTATAPGQPSGASTVWVREGGTAPATRMTVPLAPRTSEKCSVLNLTASLSVGNSTSGKRTGEGA

SEQ ID NO: 2263 - protein, 289 aa, Homo sapiens
  Payload ID: 558;
  Gene Symbol: ADAMTS10;
  Gene Name: ADAM metallopeptidase with thrombospondin type 1 motif, 10;
  ENSP ID: ENSP00000469559
MAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASSSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVRLPNFSRTRVWEAPLTSS

SEQ ID NO: 2264 - protein, 289 aa, Homo sapiens; identical to SEQ ID NO: 2263
  Payload ID: 558;
  Gene Symbol: ADAMTS10;
  Gene Name: ADAM metallopeptidase with thrombospondin type 1 motif, 10;
  ENSP ID: ENSP00000469901

SEQ ID NO: 2265 - protein, 590 aa, Homo sapiens
  Payload ID: 558;
  Gene Symbol: ADAMTS10;
  Gene Name: ADAM metallopeptidase with thrombospondin type 1 motif, 10;
  Uniprot ID:  Q9H324;
  ENSP ID: ENSP00000470501
MGPTSVLRAGLTPSCLPPPSGATNGSVSPLGRAQRVWTEPGGRGLHGATAAGPVAAACPLLAVTATAPGQPSGASTVWVREGGTAPATRMTVPLAPRTSEKCSVLNLTASLSVGNSTSGKRTGEACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEECKDVNKVAYCPLVLKFQFCSRAYFRQMCCKTCHGH

SEQ ID NO: 2266 - protein, 1103 aa, Homo sapiens; identical to SEQ ID NO: 2261
  Payload ID: 558;
  Gene Symbol: ADAMTS10;
  Gene Name: ADAM metallopeptidase with thrombospondin type 1 motif, 10;
  ENSP ID: ENSP00000471851

SEQ ID NO: 2267 - protein, 1509 aa, Homo sapiens
  Payload ID: 559;
  Gene Symbol: ADAMTS12;
  Gene Name: ADAM metallopeptidase with thrombospondin type 1 motif, 12;
  Uniprot ID:  P58397;
  ENSP ID: ENSP00000344847
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKDSVNISQKQELWREKWERHNLPSRSLSRRSISKERWVETLVVADTKMIEYHGSENVESYILTIMNMVTGLFHNPSIGNAIHIVVVRLILLEEEEQGLKIVHHAEKTLSSFCKWQKSINPKSDLNPVHHDVAVLLTRKDICAGFNRPCETLGLSHLSGMCQPHRSCNINEDSGLPLAFTIAHELGHSFGIQHDGKENDCEPVGRHPYIMSRQLQYDPTPLTWSKCSEEYITRFLDRGWGFCLDDIPKKKGLKSKVIAPGVIYDVHHQCQLQYGPNATFCQEVENVCQTLWCSVKGFCRSKLDAAADGTQCGEKKWCMAGKCITVGKKPESIPGGWGRWSPWSHCSRTCGAGVQSAERLCNNPEPKFGGKYCTGERKRYRLCNVHPCRSEAPTFRQMQCSEFDTVPYKNELYHWFPIFNPGYVDIGLIPKGARDIRVMEIEGAGNFLAIRSEDPEKYYLNGGFIIQWNGNYKLAGTVFQYDRKGDLEKLMATGPTNESVWIQLLFQVTNPGIKYEYTIQKDGLDNDVEQQMYFWQYGHWTECSVTCGTGIRRQTAHCIKKGRGMVKATFCDPETQPNGRQKKCHEKACPPRWWAGEWEACSATCGPHGEKKRTVLCIQTMVSDEQALPPTDCQHLLKPKTLLSCNRDILCPSDWTVGNWSECSVSCGGGVRIRSVTCAKNHDEPCDVTRKPNSRALCGLQQCPSSRRVLKPNKGTISNGKNPPTLKPVPPPTSRPRMLTTPTGPESMSTSTPAISSPSPTTASKEGDLGGKQWQDSSTQPELSSRYLISTGSTSQPILTSQSLSIQPSEENVSSSDTGPTSEGGLVATTTSGSGLSSSRNPITWPVTPFYNTLTKGPEMEIHSGSGEEREQPEDKDESNPVIWTKIRVPGNDAPVESTEMPLAPPLTPDLSRESWWPPFSTVMEGLLPSQRPTTSETGTPRVEGMVTEKPANTLLPLGGDHQPEPSGKTANRNHLKLPNNMNQTKSSEPVLTEEDATSLITEGFLLNASNYKQLTNGHGSAHWIVGNWSECSTTCGLGAYWRRVECSTQMDSDCAAIQRPDPAKRCHLRPCAGWKVGNWSKCSRNCSGGFKIREIQCVDSRDHRNLRPFHCQFLAGIPPPLSMSCNPEPCEAWQVEPWSQCSRSCGGGVQERGVFCPGGLCDWTKRPTSTMSCNEHLCCHWATGNWDLCSTSCGGGFQKRTVQCVPSEGNKTEDQDQCLCDHKPRPPEFKKCNQQACKKSADLLCTKDKLSASFCQTLKAMKKCSVPTVRAECCFSCPQTHITHTQRQRRQRLLQKSKEL

SEQ ID NO: 2268 - protein, 232 aa, Homo sapiens
  Payload ID: 559;
  Gene Symbol: ADAMTS12;
  Gene Name: ADAM metallopeptidase with thrombospondin type 1 motif, 12;
  ENSP ID: ENSP00000421638
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKGIVTHMSSWVEESVLFFWLFY

SEQ ID NO: 2269 - protein, 1594 aa, Homo sapiens
  Payload ID: 559;
  Gene Symbol: ADAMTS12;
  Gene Name: ADAM metallopeptidase with thrombospondin type 1 motif, 12;
  Uniprot ID:  P58397;
  ENSP ID: ENSP00000422554
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKDSVNISQKQELWREKWERHNLPSRSLSRRSISKERWVETLVVADTKMIEYHGSENVESYILTIMNMVTGLFHNPSIGNAIHIVVVRLILLEEEEQGLKIVHHAEKTLSSFCKWQKSINPKSDLNPVHHDVAVLLTRKDICAGFNRPCETLGLSHLSGMCQPHRSCNINEDSGLPLAFTIAHELGHSFGIQHDGKENDCEPVGRHPYIMSRQLQYDPTPLTWSKCSEEYITRFLDRGWGFCLDDIPKKKGLKSKVIAPGVIYDVHHQCQLQYGPNATFCQEVENVCQTLWCSVKGFCRSKLDAAADGTQCGEKKWCMAGKCITVGKKPESIPGGWGRWSPWSHCSRTCGAGVQSAERLCNNPEPKFGGKYCTGERKRYRLCNVHPCRSEAPTFRQMQCSEFDTVPYKNELYHWFPIFNPAHPCELYCRPIDGQFSEKMLDAVIDGTPCFEGGNSRNVCINGICKMVGCDYEIDSNATEDRCGVCLGDGSSCQTVRKMFKQKEGSGYVDIGLIPKGARDIRVMEIEGAGNFLAIRSEDPEKYYLNGGFIIQWNGNYKLAGTVFQYDRKGDLEKLMATGPTNESVWIQLLFQVTNPGIKYEYTIQKDGLDNDVEQQMYFWQYGHWTECSVTCGTGIRRQTAHCIKKGRGMVKATFCDPETQPNGRQKKCHEKACPPRWWAGEWEACSATCGPHGEKKRTVLCIQTMVSDEQALPPTDCQHLLKPKTLLSCNRDILCPSDWTVGNWSECSVSCGGGVRIRSVTCAKNHDEPCDVTRKPNSRALCGLQQCPSSRRVLKPNKGTISNGKNPPTLKPVPPPTSRPRMLTTPTGPESMSTSTPAISSPSPTTASKEGDLGGKQWQDSSTQPELSSRYLISTGSTSQPILTSQSLSIQPSEENVSSSDTGPTSEGGLVATTTSGSGLSSSRNPITWPVTPFYNTLTKGPEMEIHSGSGEEREQPEDKDESNPVIWTKIRVPGNDAPVESTEMPLAPPLTPDLSRESWWPPFSTVMEGLLPSQRPTTSETGTPRVEGMVTEKPANTLLPLGGDHQPEPSGKTANRNHLKLPNNMNQTKSSEPVLTEEDATSLITEGFLLNASNYKQLTNGHGSAHWIVGNWSECSTTCGLGAYWRRVECSTQMDSDCAAIQRPDPAKRCHLRPCAGWKVGNWSKCSRNCSGGFKIREIQCVDSRDHRNLRPFHCQFLAGIPPPLSMSCNPEPCEAWQVEPWSQCSRSCGGGVQERGVFCPGGLCDWTKRPTSTMSCNEHLCCHWATGNWDLCSTSCGGGFQKRTVQCVPSEGNKTEDQDQCLCDHKPRPPEFKKCNQQACKKSADLLCTKDKLSASFCQTLKAMKKCSVPTVRAECCFSCPQTHITHTQRQRRQRLLQKSKEL

SEQ ID NO: 2270 - protein, 163 aa, Homo sapiens
  Payload ID: 559;
  Gene Symbol: ADAMTS12;
  Gene Name: ADAM metallopeptidase with thrombospondin type 1 motif, 12;
  ENSP ID: ENSP00000486213
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGL

SEQ ID NO: 2271 - protein, 163 aa, Homo sapiens; identical to SEQ ID NO: 2270
  Payload ID: 559;
  Gene Symbol: ADAMTS12;
  Gene Name: ADAM metallopeptidase with thrombospondin type 1 motif, 12;
  ENSP ID: ENSP00000486915

SEQ ID NO: 2272 - protein, 1371 aa, Homo sapiens; identical to SEQ ID NO: 2254
  Payload ID: 560;
  Gene Symbol: ADAMTS13;
  Gene Name: ADAM metallopeptidase with thrombospondin type 1 motif, 13;
  Uniprot ID:  Q76LX8;
  ENSP ID: ENSP00000347927

SEQ ID NO: 2273 - protein, 1340 aa, Homo sapiens; identical to SEQ ID NO: 2250
  Payload ID: 560;
  Gene Symbol: ADAMTS13;
  Gene Name: ADAM metallopeptidase with thrombospondin type 1 motif, 13;
  Uniprot ID:  Q76LX8;
  ENSP ID: ENSP00000348997

SEQ ID NO: 2274 - protein, 223 aa, Homo sapiens; identical to SEQ ID NO: 2256
  Payload ID: 560;
  Gene Symbol: ADAMTS13;
  Gene Name: ADAM metallopeptidase with thrombospondin type 1 motif, 13;
  ENSP ID: ENSP00000360978

SEQ ID NO: 2275 - protein, 344 aa, Homo sapiens; identical to SEQ ID NO: 2249
  Payload ID: 560;
  Gene Symbol: ADAMTS13;
  Gene Name: ADAM metallopeptidase with thrombospondin type 1 motif, 13;
  ENSP ID: ENSP00000360979

SEQ ID NO: 2276 - protein, 444 aa, Homo sapiens; identical to SEQ ID NO: 2255
  Payload ID: 560;
  Gene Symbol: ADAMTS13;
  Gene Name: ADAM metallopeptidase with thrombospondin type 1 motif, 13;
  ENSP ID: ENSP00000360984

SEQ ID NO: 2277 - protein, 1427 aa, Homo sapiens; identical to SEQ ID NO: 2252
  Payload ID: 560;
  Gene Symbol: ADAMTS13;
  Gene Name: ADAM metallopeptidase with thrombospondin type 1 motif, 13;
  Uniprot ID:  Q76LX8;
  ENSP ID: ENSP00000360997

SEQ ID NO: 2278 - protein, 344 aa, Homo sapiens; identical to SEQ ID NO: 2249
  Payload ID: 560;
  Gene Symbol: ADAMTS13;
  Gene Name: ADAM metallopeptidase with thrombospondin type 1 motif, 13;
  ENSP ID: ENSP00000435274

SEQ ID NO: 2279 - protein, 276 aa, Homo sapiens; identical to SEQ ID NO: 2253
  Payload ID: 560;
  Gene Symbol: ADAMTS13;
  Gene Name: ADAM metallopeptidase with thrombospondin type 1 motif, 13;
  ENSP ID: ENSP00000435305

SEQ ID NO: 2280 - protein, 1223 aa, Homo sapiens
  Payload ID: 561;
  Gene Symbol: ADAMTS14;
  Gene Name: ADAM metallopeptidase with thrombospondin type 1 motif, 14;
  Uniprot ID:  Q8WXS8;
  ENSP ID: ENSP00000362303
MAPLRALLSYLLPLHCALCAAAGSRTPELHLSGKLSDYGVTVPCSTDFRGRFLSHVVSGPAAASAGSMVVDTPPTLPRHSSHLRVARSPLHPGGTLWPGRVGRHSLYFNVTVFGKELHLRLRPNRRLVVPGSSVEWQEDFRELFRQPLRQECVYTGGVTGMPGAAVAISNCDGLAGLIRTDSTDFFIEPLERGQQEKEASGRTHVVYRREAVQQEWAEPDGDLHNEAFGLGDLPNLLGLVGDQLGDTERKRRHAKPGSYSIEVLLVVDDSVVRFHGKEHVQNYVLTLMNIVDEIYHDESLGVHINIALVRLIMVGYRQSLSLIERGNPSRSLEQVCRWAHSQQRQDPSHAEHHDHVVFLTRQDFGPSGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAFRTFEPCKQLWCSHPDNPYFCKTKKGPPLDGTECAPGKWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDAQKCELICQSADTGDVVFMNQVVHDGTRCSYRDPYSVCARGECVPVGCDKEVGSMKADDKCGVCGGDNSHCRTVKGTLGKASKQAGALKLVQIPAGARHIQIEALEKSPHRIVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSTPGSPLPGPQDPADAAEPPGKPTGSEDHQHGRATQLPGALDTSSPGTQHPFAPETPIPGASWSISPTTPGGLPWGWTQTPTPVPEDKGQPGEDLRHPGTSLPAASPVT

SEQ ID NO: 2281 - protein, 1226 aa, Homo sapiens
  Payload ID: 561;
  Gene Symbol: ADAMTS14;
  Gene Name: ADAM metallopeptidase with thrombospondin type 1 motif, 14;
  Uniprot ID:  Q8WXS8;
  ENSP ID: ENSP00000362304
MAPLRALLSYLLPLHCALCAAAGSRTPELHLSGKLSDYGVTVPCSTDFRGRFLSHVVSGPAAASAGSMVVDTPPTLPRHSSHLRVARSPLHPGGTLWPGRVGRHSLYFNVTVFGKELHLRLRPNRRLVVPGSSVEWQEDFRELFRQPLRQECVYTGGVTGMPGAAVAISNCDGLAGLIRTDSTDFFIEPLERGQQEKEASGRTHVVYRREAVQQEWAEPDGDLHNEAFGLGDLPNLLGLVGDQLGDTERKRRHAKPGSYSIEVLLVVDDSVVRFHGKEHVQNYVLTLMNIVDEIYHDESLGVHINIALVRLIMVGYRQSLSLIERGNPSRSLEQVCRWAHSQQRQDPSHAEHHDHVVFLTRQDFGPSGMQGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAFRTFEPCKQLWCSHPDNPYFCKTKKGPPLDGTECAPGKWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDAQKCELICQSADTGDVVFMNQVVHDGTRCSYRDPYSVCARGECVPVGCDKEVGSMKADDKCGVCGGDNSHCRTVKGTLGKASKQAGALKLVQIPAGARHIQIEALEKSPHRIVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSTPGSPLPGPQDPADAAEPPGKPTGSEDHQHGRATQLPGALDTSSPGTQHPFAPETPIPGASWSISPTTPGGLPWGWTQTPTPVPEDKGQPGEDLRHPGTSLPAASPVT

SEQ ID NO: 2282 - protein, 950 aa, Homo sapiens
  Payload ID: 562;
  Gene Symbol: ADAMTS15;
  Gene Name: ADAM metallopeptidase with thrombospondin type 1 motif, 15;
  Uniprot ID:  Q8TE58;
  ENSP ID: ENSP00000299164
MLLLGILTLAFAGRTAGGSEPEREVVVPIRLDPDINGRRYYWRGPEDSGDQGLIFQITAFQEDFYLHLTPDAQFLAPAFSTEHLGVPLQGLTGGSSDLRRCFYSGDVNAEPDSFAAVSLCGGLRGAFGYRGAEYVISPLPNASAPAAQRNSQGAHLLQRRGVPGGPSGDPTSRCGVASGWNPAILRALDPYKPRRAGFGESRSRRRSGRAKRFVSIPRYVETLVVADESMVKFHGADLEHYLLTLLATAARLYRHPSILNPINIVVVKVLLLRDRDSGPKVTGNAALTLRNFCAWQKKLNKVSDKHPEYWDTAILFTRQDLCGATTCDTLGMADVGTMCDPKRSCSVIEDDGLPSAFTTAHELGHVFNMPHDNVKVCEEVFGKLRANHMMSPTLIQIDRANPWSACSAAIITDFLDSGHGDCLLDQPSKPISLPEDLPGASYTLSQQCELAFGVGSKPCPYMQYCTKLWCTGKAKGQMVCQTRHFPWADGTSCGEGKLCLKGACVERHNLNKHRVDGSWAKWDPYGPCSRTCGGGVQLARRQCTNPTPANGGKYCEGVRVKYRSCNLEPCPSSASGKSFREEQCEAFNGYNHSTNRLTLAVAWVPKYSGVSPRDKCKLICRANGTGYFYVLAPKVVDGTLCSPDSTSVCVQGKCIKAGCDGNLGSKKRFDKCGVCGGDNKSCKKVTGLFTKPMHGYNFVVAIPAGASSIDIRQRGYKGLIGDDNYLALKNSQGKYLLNGHFVVSAVERDLVVKGSLLRYSGTGTAVESLQASRPILEPLTVEVLSVGKMTPPRVRYSFYLPKEPREDKSSHPKDPRGPSVLHNSVLSLSNQVEQPDDRPPARWVAGSWGPCSASCGSGLQKRAVDCRGSAGQRTVPACDAAHRPVETQACGEPCPTWELSAWSPCSKSCGRGFQRRSLKCVGHGGRLLARDQCNLHRKPQELDFCVLRPC

SEQ ID NO: 2283 - protein, 1224 aa, Homo sapiens
  Payload ID: 563;
  Gene Symbol: ADAMTS16;
  Gene Name: ADAM metallopeptidase with thrombospondin type 1 motif, 16;
  Uniprot ID:  Q8TE57;
  ENSP ID: ENSP00000274181
MKPRARGWRGLAALWMLLAQVAEQAPACAMGPAAAAPGSPSVPRPPPPAERPGWMEKGEYDLVSAYEVDHRGDYVSHEIMHHQRRRRAVPVSEVESLHLRLKGSRHDFHMDLRTSSSLVAPGFIVQTLGKTGTKSVQTLPPEDFCFYQGSLRSHRNSSVALSTCQGLSGMIRTEEADYFLRPLPSHLSWKLGRAAQGSSPSHVLYKRSTEPHAPGASEVLVTSRTWELAHQPLHSSDLRLGLPQKQHFCGRRKKYMPQPPKEDLFILPDEYKSCLRHKRSLLRSHRNEELNVETLVVVDKKMMQNHGHENITTYVLTILNMVSALFKDGTIGGNINIAIVGLILLEDEQPGLVISHHADHTLSSFCQWQSGLMGKDGTRHDHAILLTGLDICSWKNEPCDTLGFAPISGMCSKYRSCTINEDTGLGLAFTIAHESGHNFGMIHDGEGNMCKKSEGNIMSPTLAGRNGVFSWSPCSRQYLHKFLSTAQAICLADQPKPVKEYKYPEKLPGELYDANTQCKWQFGEKAKLCMLDFKKDICKALWCHRIGRKCETKFMPAAEGTICGHDMWCRGGQCVKYGDEGPKPTHGHWSDWSSWSPCSRTCGGGVSHRSRLCTNPKPSHGGKFCEGSTRTLKLCNSQKCPRDSVDFRAAQCAEHNSRRFRGRHYKWKPYTQVEDQDLCKLYCIAEGFDFFFSLSNKVKDGTPCSEDSRNVCIDGICERVGCDNVLGSDAVEDVCGVCNGNNSACTIHRGLYTKHHHTNQYYHMVTIPSGARSIRIYEMNVSTSYISVRNALRRYYLNGHWTVDWPGRYKFSGTTFDYRRSYNEPENLIATGPTNETLIVELLFQGRNPGVAWEYSMPRLGTEKQPPAQPSYTWAIVRSECSVSCGGGQMTVREGCYRDLKFQVNMSFCNPKTRPVTGLVPCKVSACPPSWSVGNWSACSRTCGGGAQSRPVQCTRRVHYDSEPVPASLCPQPAPSSRQACNSQSCPPAWSAGPWAECSHTCGKGWRKRAVACKSTNPSARAQLLPDAVCTSEPKPRMHEACLLQRCHKPKKLQWLVSAWSQCSVTCERGTQKRFLKCAEKYVSGKYRELASKKCSHLPKPSLELERACAPLPCPRHPPFAAAGPSRGSWFASPWSQCTASCGGGVQTRSVQCLAGGRPASGCLLHQKPSASLACNTHFCPIAEKKDAFCKDYFHWCYLVPQHGMCSHKFYGKQCCKTCSKSNL

SEQ ID NO: 2284 - protein, 570 aa, Homo sapiens
  Payload ID: 563;
  Gene Symbol: ADAMTS16;
  Gene Name: ADAM metallopeptidase with thrombospondin type 1 motif, 16;
  ENSP ID: ENSP00000421631
MKPRARGWRGLAALWMLLAQVAEQAPACAMGPAAAAPGSPSVPRPPPPAERPGWMEKGEYDLVSAYEVDHRGDYVSHEIMHHQRRRRAVPVSEVESLHLRLKGSRHDFHMDLRTSSSLVAPGFIVQTLGKTGTKSVQTLPPEDFCFYQGSLRSHRNSSVALSTCQGLSGMIRTEEADYFLRPLPSHLSWKLGRAAQGSSPSHVLYKRSTEPHAPGASEVLVTSRTWELAHQPLHSSDLRLGLPQKQHFCGRRKKYMPQPPKEDLFILPDEYKSCLRHKRSLLRSHRNEELNVETLVVVDKKMMQNHGHENITTYVLTILNMVSALFKDGTIGGNINIAIVGLILLEDEQPGLVISHHADHTLSSFCQWQSGLMGKDGTRHDHAILLTGLDICSWKNEPCDTLGFAPISGMCSKYRSCTINEDTGLGLAFTIAHESGHNFGMIHDGEGNMCKKSEGNIMSPTLAGRNGVFSWSPCSRQYLHKFLSTAQAICLADQPKPVKEYKYPEKLPGELYDANTQCKWQFGEKAKLCMLDFKKDICKALWCHRIGRKCETKFMPAAEGTICGHDMVRS

SEQ ID NO: 2285 - protein, 1095 aa, Homo sapiens
  Payload ID: 564;
  Gene Symbol: ADAMTS17;
  Gene Name: ADAM metallopeptidase with thrombospondin type 1 motif, 17;
  Uniprot ID:  Q8TE56;
  ENSP ID: ENSP00000268070
MCDGALLPPLVLPVLLLLVWGLDPGTAVGDAAADVEVVLPWRVRPDDVHLPPLPAAPGPRRRRRPRTPPAAPRARPGERALLLHLPAFGRDLYLQLRRDLRFLSRGFEVEEAGAARRRGRPAELCFYSGRVLGHPGSLVSLSACGAAGGLVGLIQLGQEQVLIQPLNNSQGPFSGREHLIRRKWSLTPSPSAEAQRPEQLCKVLTEKKKPTWGRPSRDWRERRNAIRLTSEHTVETLVVADADMVQYHGAEAAQRFILTVMNMVYNMFQHQSLGIKINIQVTKLVLLRQRPAKLSIGHHGERSLESFCHWQNEEYGGARYLGNNQVPGGKDDPPLVDAAVFVTRTDFCVHKDEPCDTVGIAYLGGVCSAKRKCVLAEDNGLNLAFTIAHELGHNLGMNHDDDHSSCAGRSHIMSGEWVKGRNPSDLSWSSCSRDDLENFLKSKVSTCLLVTDPRSQHTVRLPHKLPGMHYSANEQCQILFGMNATFCRNMEHLMCAGLWCLVEGDTSCKTKLDPPLDGTECGADKWCRAGECVSKTPIPEHVDGDWSPWGAWSMCSRTCGTGARFRQRKCDNPPPGPGGTHCPGASVEHAVCENLPCPKGLPSFRDQQCQAHDRLSPKKKGLLTAVVVDDKPCELYCSPLGKESPLLVADRVLDGTPCGPYETDLCVHGKCQKIGCDGIIGSAAKEDRCGVCSGDGKTCHLVKGDFSHARGTALKDSGKGSINSDWKIELPGEFQIAGTTVRYVRRGLWEKISAKGPTKLPLHLMVLLFHDQDYGIHYEYTVPVNRTAENQSEPEKPQDSLFIWTHSGWEGCSVQCGGGERRTIVSCTRIVNKTTTLVNDSDCPQASRPEPQVRRCNLHPCQSRWVAGPWSPCSATCEKGFQHREVTCVYQLQNGTHVATRPLYCPGPRPAAVQSCEGQDCLSIWEASEWSQCSASCGKGVWKRTVACTNSQGKCDASTRPRAEEACEDYSGCYEWKTGDWSTCSSTCGKGLQSRVVQCMHKVTGRHGSECPALSKPAPYRQCYQEVCNDRINANTITSPRLAALTYKCTRDQWTVYCRVIREKNLCQDMRWYQRCCQTCRDFYANKMRQPPPNS

SEQ ID NO: 2286 - protein, 68 aa, Homo sapiens
  Payload ID: 564;
  Gene Symbol: ADAMTS17;
  Gene Name: ADAM metallopeptidase with thrombospondin type 1 motif, 17;
  ENSP ID: ENSP00000453604
MCDGALLPPLVLPVLLLLVWGLDPGTGWPHSAWAGAGANPAPQQLPGPIQWTRTSDQAQMVLDPQPFC

SEQ ID NO: 2287 - protein, 214 aa, Homo sapiens
  Payload ID: 564;
  Gene Symbol: ADAMTS17;
  Gene Name: ADAM metallopeptidase with thrombospondin type 1 motif, 17;
  ENSP ID: ENSP00000456161
  MOD_RES (1)..(1): Any amino acid
XELYCSPLGKESPLLVADRVLDGTPCGPYETDLCVHGKCQKIGCDGIIGSAAKEDRCGVCSGDGKTCHLVKGDFSHARGTGYIEAAVIPAGARRIRVVEDKPAHSFLALKDSGKGSINSDWKIELPGEFQIAGTTVRYVRRGLWEKISAKGPTKLPLHLMVLLFHDQDYGIHYEYTVPVNRTAENQSEPEKPQDSLFIWTHSGWEGCSVQCGGG

SEQ ID NO: 2288 - protein, 120 aa, Homo sapiens
  Payload ID: 564;
  Gene Symbol: ADAMTS17;
  Gene Name: ADAM metallopeptidase with thrombospondin type 1 motif, 17;
  ENSP ID: ENSP00000458005
  MOD_RES (1)..(1): Any amino acid
XGRPAELCFYSGRVLGHPGSLVSLSACGAAGGLVGLIQLGQEQVLIQPLNNSQGPFSGREHLIRRKWSLTPSPSAEAQRPEQLCKVLTVPQCLGLTWEDLKSGGWSDLEVPHSCVWPGGG

SEQ ID NO: 2289 - protein, 1221 aa, Homo sapiens
  Payload ID: 565;
  Gene Symbol: ADAMTS18;
  Gene Name: ADAM metallopeptidase with thrombospondin type 1 motif, 18;
  Uniprot ID:  Q8TE60;
  ENSP ID: ENSP00000282849
MECALLLACAFPAAGSGPPRGLAGLGRVAKALQLCCLCCASVAAALASDSSSGASGLNDDYVFVTPVEVDSAGSYISHDILHNGRKKRSAQNARSSLHYRFSAFGQELHLELKPSAILSSHFIVQVLGKDGASETQKPEVQQCFYQGFIRNDSSSSVAVSTCAGLSGLIRTRKNEFLISPLPQLLAQEHNYSSPAGHHPHVLYKRTAEEKIQRYRGYPGSGRNYPGYSPSHIPHASQSRETEYHHRRLQKQHFCGRRKKYAPKPPTEDTYLRFDEYGSSGRPRRSAGKSQKGLNVETLVVADKKMVEKHGKGNVTTYILTVMNMVSGLFKDGTIGSDINVVVVSLILLEQEPGGLLINHHADQSLNSFCQWQSALIGKNGKRHDHAILLTGFDICSWKNEPCDTLGFAPISGMCSKYRSCTINEDTGLGLAFTIAHESGHNFGMIHDGEGNPCRKAEGNIMSPTLTGNNGVFSWSSCSRQYLKKFLSTPQAGCLVDEPKQAGQYKYPDKLPGQIYDADTQCKWQFGAKAKLCSLGFVKDICKSLWCHRVGHRCETKFMPAAEGTVCGLSMWCRQGQCVKFGELGPRPIHGQWSAWSKWSECSRTCGGGVKFQERHCNNPKPQYGGLFCPGSSRIYQLCNINPCNENSLDFRAQQCAEYNSKPFRGWFYQWKPYTKVEEEDRCKLYCKAENFEFFFAMSGKVKDGTPCSPNKNDVCIDGVCELVGCDHELGSKAVSDACGVCKGDNSTCKFYKGLYLNQHKANEYYPVVLIPAGARSIEIQELQVSSSYLAVRSLSQKYYLTGGWSIDWPGEFPFAGTTFEYQRSFNRPERLYAPGPTNETLVFEILMQGKNPGIAWKYALPKVMNGTPPATKRPAYTWSIVQSECSVSCGGGYINVKAICLRDQNTQVNSSFCSAKTKPVTEPKICNAFSCPAYWMPGEWSTCSKACAGGQQSRKIQCVQKKPFQKEEAVLHSLCPVSTPTQVQACNSHACPPQWSLGPWSQCSKTCGRGVRKRELLCKGSAAETLPESQCTSLPRPELQEGCVLGRCPKNSRLQWVASSWSECSATCGLGVRKREMKCSEKGFQGKLITFPERRCRNIKKPNLDLEETCNRRACPAHPVYNMVAGWYSLPWQQCTVTCGGGVQTRSVHCVQQGRPSSSCLLHQKPPVLRACNTNFCPAPEKREDPSCVDFFNWCHLVPQHGVCNHKFYGKQCCKSCTRKI

SEQ ID NO: 2290 - protein, 274 aa, Homo sapiens
  Payload ID: 565;
  Gene Symbol: ADAMTS18;
  Gene Name: ADAM metallopeptidase with thrombospondin type 1 motif, 18;
  ENSP ID: ENSP00000392540
MECALLLACAFPAAGSGPPRGLAGLGRVAKALQLCCLCCASVAAALASDSSSGASGLNDDYVFVTPVEVDSAGSYISHDILHNGRKKRSAQNARSSLHYRFSAFGQELHLELKPSAILSSHFIVQVLGKDGASETQKPEVQQCFYQGFIRNDSSSSVAVSTCAGLSGLIRTRKNEFLISPLPQLLAQEHNYSSPAGHHPHVLYKRTAEEKIQRYRGYPGSGRNYPGYSPSHIPHASQSRETEYHHRRLQKQHFCGRRKKCICSQASHRGHLSKV

SEQ ID NO: 2291 - protein, 62 aa, Homo sapiens
  Payload ID: 565;
  Gene Symbol: ADAMTS18;
  Gene Name: ADAM metallopeptidase with thrombospondin type 1 motif, 18;
  ENSP ID: ENSP00000454368
  MOD_RES (1)..(1): Any amino acid
XQGRPSSSCLLHQKPPVLRACNTNFCPAPEKRDSAGSQLPCCDGPQAVHEEGLRFPDNHWAM

SEQ ID NO: 2292 - protein, 185 aa, Homo sapiens
  Payload ID: 565;
  Gene Symbol: ADAMTS18;
  Gene Name: ADAM metallopeptidase with thrombospondin type 1 motif, 18;
  ENSP ID: ENSP00000457395
  MOD_RES (1)..(1): Any amino acid
XVDSAGSYISHDILHNGRKKRSAQNARSSLHYRFSAFGQELHLELKPSAILSSHFIVQVLGKDGASETQKPEVQQCFYQGFIRNDSSSSVAVSTCAGLLLAQEHNYSSPAGHHPHVLYKRTAEEKIQRYRGYPGSGRNYPGYSPSHIPHASQSRETEYHHRRLQKQHFCGRRKKCICSQASHRGH

SEQ ID NO: 2293 - protein, 1207 aa, Homo sapiens
  Payload ID: 566;
  Gene Symbol: ADAMTS19;
  Gene Name: ADAM metallopeptidase with thrombospondin type 1 motif, 19;
  Uniprot ID:  Q8TE59;
  ENSP ID: ENSP00000274487
MRLTHICCCCLLYQLGFLSNGIVSELQFAPDREEWEVVFPALWRREPVDPAGGSGGSADPGWVRGVGGGGSARAQAAGSSREVRSVAPVPLEEPVEGRSESRLRPPPPSEGEEDEELESQELPRGSSGAAALSPGAPASWQPPPPPQPPPSPPPAQHAEPDGDEVLLRIPAFSRDLYLLLRRDGRFLAPRFAVEQRPNPGPGPTGAASAPQPPAPPDAGCFYTGAVLRHPGSLASFSTCGGGLMGFIQLNEDFIFIEPLNDTMAITGHPHRVYRQKRSMEEKVTEKSALHSHYCGIISDKGRPRSRKIAESGRGKRYSYKLPQEYNIETVVVADPAMVSYHGADAARRFILTILNMVFNLFQHKSLSVQVNLRVIKLILLHETPPELYIGHHGEKMLESFCKWQHEEFGKKNDIHLEMSTNWGEDMTSVDAAILITRKDFCVHKDEPCDTVGIAYLSGMCSEKRKCIIAEDNGLNLAFTIAHEMGHNMGINHDNDHPSCADGLHIMSGEWIKGQNLGDVSWSRCSKEDLERFLRSKASNCLLQTNPQSVNSVMVPSKLPGMTYTADEQCQILFGPLASFCQEMQHVICTGLWCKVEGEKECRTKLDPPMDGTDCDLGKWCKAGECTSRTSAPEHLAGEWSLWSPCSRTCSAGISSRERKCPGLDSEARDCNGPRKQYRICENPPCPAGLPGFRDWQCQAYSVRTSSPKHILQWQAVLDEEKPCALFCSPVGKEQPILLSEKVMDGTSCGYQGLDICANGRCQKVGCDGLLGSLAREDHCGVCNGNGKSCKIIKGDFNHTRGAGYVEVLVIPAGARRIKVVEEKPAHSYLALRDAGKQSINSDWKIEHSGAFNLAGTTVHYVRRGLWEKISAKGPTTAPLHLLVLLFQDQNYGLHYEYTIPSDPLPENQSSKAPEPLFMWTHTSWEDCDATCGGGERKTTVSCTKIMSKNISIVDNEKCKYLTKPEPQIRKCNEQPCQTRWMMTEWTPCSRTCGKGMQSRQVACTQQLSNGTLIRARERDCIGPKPASAQRCEGQDCMTVWEAGVWSECSVKCGKGIRHRTVRCTNPRKKCVLSTRPREAEDCEDYSKCYVWRMGDWSKCSITCGKGMQSRVIQCMHKITGRHGNECFSSEKPAAYRPCHLQPCNEKINVNTITSPRLAALTFKCLGDQWPVYCRVIREKNLCQDMRWYQRCCETCRDFYAQKLQQKS

SEQ ID NO: 2294 - protein, 145 aa, Homo sapiens
  Payload ID: 566;
  Gene Symbol: ADAMTS19;
  Gene Name: ADAM metallopeptidase with thrombospondin type 1 motif, 19;
  ENSP ID: ENSP00000422491
  MOD_RES (1)..(1): Any amino acid
XDAGCFYTGAVLRHPGSLASFSTCGGGLMGFIQLNEDFIFIEPLNDTMAITGHPHRVYRQKRSMEEKVTEKSALHSHYCGIISDKGRPRSRKIAESGRGKRYSYKLPQEYNIETVVVADPAMVSYHGADAARRFILTILNMVGKL

SEQ ID NO: 2295 - protein, 31 aa, Homo sapiens
  Payload ID: 566;
  Gene Symbol: ADAMTS19;
  Gene Name: ADAM metallopeptidase with thrombospondin type 1 motif, 19;
  ENSP ID: ENSP00000423537
MRLTHICCCCLLYQLGFLSNGIVSDGIYTAQ

SEQ ID NO: 2296 - protein, 1211 aa, Homo sapiens
  Payload ID: 567;
  Gene Symbol: ADAMTS2;
  Gene Name: ADAM metallopeptidase with thrombospondin type 1 motif, 2;
  Uniprot ID:  O95450;
  ENSP ID: ENSP00000251582
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKHCFKGHCIWLTPDILKRDGSWGAWSPFGSCSRTCGTGVKFRTRQCDNPHPANGGRTCSGLAYDFQLCSRQDCPDSLADFREEQCRQWDLYFEHGDAQHHWLPHEHRDAKERCHLYCESRETGEVVSMKRMVHDGTRCSYKDAFSLCVRGDCRKVGCDGVIGSSKQEDKCGVCGGDNSHCKVVKGTFTRSPKKHGYIKMFEIPAGARHLLIQEVDATSHHLAVKNLETGKFILNEENDVDASSKTFIAMGVEWEYRDEDGRETLQTMGPLHGTITVLVIPVGDTRVSLTYKYMIHEDSLNVDDNNVLEEDSVVYEWALKKWSPCSKPCGGGSQFTKYGCRRRLDHKMVHRGFCAALSKPKAIRRACNPQECSQPVWVTGEWEPCSQTCGRTGMQVRSVRCIQPLHDNTTRSVHAKHCNDARPESRRACSRELCPGRWRAGPWSQCSVTCGNGTQERPVLCRTADDSFGICQEERPETARTCRLGPCPRNISDPSKKSYVVQWLSRPDPDSPIRKISSKGHCQGDKSIFCRMEVLSRYCSIPGYNKLCCKSCNLYNNLTNVEGRIEPPPGKHNDIDVFMPTLPVPTVAMEVRPSPSTPLEVPLNASSTNATEDHPETNAVDEPYKIHGLEDEVQPPNLIPRRPSPYEKTRNQRIQELIDEMRKKEMLGKF

SEQ ID NO: 2297 - protein, 566 aa, Homo sapiens
  Payload ID: 567;
  Gene Symbol: ADAMTS2;
  Gene Name: ADAM metallopeptidase with thrombospondin type 1 motif, 2;
  Uniprot ID:  O95450;
  ENSP ID: ENSP00000274609
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKFRPGAVAHACYPSTLGGQGRWIA

SEQ ID NO: 2298 - protein, 1910 aa, Homo sapiens
  Payload ID: 568;
  Gene Symbol: ADAMTS20;
  Gene Name: ADAM metallopeptidase with thrombospondin type 1 motif, 20;
  Uniprot ID:  P59510;
  ENSP ID: ENSP00000374071
MWVAKWLTGLLYHLSLFITRSWEVDFHPRQEALVRTLTSYEVVIPERVNEFGEVFPQSHHFSRQKRSSEALEPMPFRTHYRFTAYGQLFQLNLTADASFLAAGYTEVHLGTPERGAWESDAGPSDLRHCFYRGQVNSQEDYKAVVSLCGGLTGTFKGQNGEYFLEPIMKADGNEYEDGHNKPHLIYRQDLNNSFLQTLKYCSVSESQIKETSLPFHTYSNMNEDLNVMKERVLGHTSKNVPLKDERRHSRKKRLISYPRYIEIMVTADAKVVSAHGSNLQNYILTLMSIVATIYKDPSIGNLIHIVVVKLVMIHREEEGPVINFDGATTLKNFCSWQQTQNDLDDVHPSHHDTAVLITREDICSSKEKCNMLGLSYLGTICDPLQSCFINEEKGLISAFTIAHELGHTLGVQHDDNPRCKEMKVTKYHVMAPALSFHMSPWSWSNCSRKYVTEFLDTGYGECLLDKPDEEIYNLPSELPGSRYDGNKQCELAFGPGSQMCPHINICMHLWCTSTEKLHKGCFTQHVPPADGTDCGPGMHCRHGLCVNKETETRPVNGEWGPWEPYSSCSRTCGGGIESATRRCNRPEPRNGGNYCVGRRMKFRSCNTDSCPKGTQDFREKQCSDFNGKHLDISGIPSNVRWLPRYSGIGTKDRCKLYCQVAGTNYFYLLKDMVEDGTPCGTETHDICVQGQCMAAGCDHVLNSSAKIDKCGVCGGDNSSCKTITGVFNSSHYGYNVVVKIPAGATNVDIRQYSYSGQPDDSYLALSDAEGNFLFNGNFLLSTSKKEINVQGTRTVIEYSGSNNAVERINSTNRQEKELILQVLCVGNLYNPDVHYSFNIPLEERSDMFTWDPYGPWEGCTKMCQGLQRRNITCIHKSDHSVVSDKECDHLPLPSFVTQSCNTDCELRWHVIGKSECSSQCGQGYRTLDIHCMKYSIHEGQTVQVDDHYCGDQLKPPTQELCHGNCVFTRWHYSEWSQCSRSCGGGERSRESYCMNNFGHRLADNECQELSRVTRENCNEFSCPSWAASEWSECLVTCGKGTKQRQVWCQLNVDHLSDGFCNSSTKPESLSPCELHTCASWQVGPWGPCTTTCGHGYQMRDVKCVNELASAVLEDTECHEASRPSDRQSCVLTPCSFISKLETALLPTVLIKKMAQWRHGSWTPCSVSCGRGTQARYVSCRDALDRIADESYCAHLPRPAEIWDCFTPCGEWQAGDWSPCSASCGHGKTTRQVLCMNYHQPIDENYCDPEVRPLMEQECSLAACPPAHSHFPSSPVQPSYYLSTNLPLTQKLEDNENQVVHPSVRGNQWRTGPWGSCSSSCSGGLQHRAVVCQDENGQSASYCDAASKPPELQQCGPGPCPQWNYGNWGECSQTCGGGIKSRLVICQFPNGQILEDHNCEIVNKPPSVIQCHMHACPADVSWHQEPWTSCSASCGKGRKYREVFCIDQFQRKLEDTNCSQVQKPPTHKACRSVRCPSWKANSWNECSVTCGSGVQQRDVYCRLKGVGQVVEEMCDQSTRPCSQRRCWSQDCVQHKGMERGRLNCSTSCERKDSHQRMECTDNQIRQVNEIVYNSSTISLTSKNCRNPPCNYIVVTADSSQCANNCGFSYRQRITYCTEIPSTKKHKLHRLRPIVYQECPVVPSSQVYQCINSCLHLATWKVGKWSKCSVTCGIGIMKRQVKCITKHGLSSDLCLNHLKPGAQKKCYANDCKSFTTCKEIQVKNHIRKDGDYYLNIKGRIIKIYCADMYLENPKEYLTLVQGEENFSEVYGFRLKNPYQCPFNGSRREDCECDNGHLAAGYTVFSKIRIDLTSMQIKTTDLLFSKTIFGNAVPFATAGDCYSAFRCPQGQFSINLSGTGMKISSTAKWLTQGSYTSVSIRRSEDGTRFFGKCGGYCGKCLPHMTTGLPIQVI

SEQ ID NO: 2299 - protein, 1504 aa, Homo sapiens [sequence omitted]

SEQ ID NO: 2300 - protein, 634 aa, Homo sapiens
  Payload ID: 568;
  Gene Symbol: ADAMTS20;
  Gene Name: ADAM metallopeptidase with thrombospondin type 1 motif, 20;
  ENSP ID: ENSP00000447427
YSFNIPLEERSDMFTWDPYGPWEGCTKMCQGLQRRNITCIHKSDHSVVSDKECDHLPLPSFVTQSCNTDCELRWHVIGKSECSSQCGQGYRTLDIHCMKYSIHEGQTVQVDDHYCGDQLKPPTQELCHGNCVFTRWHYSEWSQCSRSCGGGERSRESYCMNNFGHRLADNECQELSRVTRENCNEFSCPSWAASEWSECLVTCGKGTKQRQVWCQLNVDHLSDGFCNSSTKPESLSPCELHTCASWQVGPWGPCTTTCGHGYQMRDVKCVNELASAVLEDTECHEASRPSDRQCSVSCGRGTQARYVSCRDALDRIADESYCAHLPRPAEIWDCFTPCGEWQAGDWSPCSASCGHGKTTRQVLCMNYHQPIDENYCDPEVRPLMEQECSLAACPPAHSHFPSSPVQPSYYLSTNLPLTQKLEDNENQVVHPSVRGNQWRTGPWGSCSSSCSGGLQHRAVVCQDENGQSASYCDAASKPPELQQCGPGPCPQWNYGNWGECSQTCGGGIKSRLVICQFPNGQILEDHNCEIVNKPPSVIQCHMHACPADVSWHQEPWTSEDLKVKLLPQRTIILWELMKNIFCHGKHSHMYLINVVTDHLLYPRHCDPETIETYFLSLWSLQFTWGDLKYYKNSL

SEQ ID NO: 2301 - protein, 1504 aa, Homo sapiens
  Payload ID: 568;
  Gene Symbol: ADAMTS20;
  Gene Name: ADAM metallopeptidase with thrombospondin type 1 motif, 20;
  ENSP ID: ENSP00000448341
MWVAKWLTGLLYHLSLFITRSWEVDFHPRQEALVRTLTSYEVVIPERVNEFGEVFPQSHHFSRQKRSSEALEPMPFRTHYRFTAYGQLFQLNLTADASFLAAGYTEVHLGTPERGAWESDAGPSDLRHCFYRGQVNSQEDYKAVVSLCGGLTGTFKGQNGEYFLEPIMKADGNEYEDGHNKPHLIYRQDLNNSFLQTLKYCSVSESQIKETSLPFHTYSNMNEDLNVMKERVLGHTSKNVPLKDERRHSRKKRLISYPRYIEIMVTADAKVVSAHGSNLQNYILTLMSIVATIYKDPSIGNLIHIVVVKLVMIHREEEGPVINFDGATTLKNFCSWQQTQNDLDDVHPSHHDTAVLITREDICSSKEKCNMLGLSYLGTICDPLQSCFINEEKGLISAFTIAHELGHTLGVQHDDNPRCKEMKVTKYHVMAPALSFHMSPWSWSNCSRKYVTEFLDTGYGECLLDKPDEEIYNLPSELPGSRYDGNKQCELAFGPGSQMCPHINICMHLWCTSTEKLHKGCFTQHVPPADGTDCGPGMHCRHGLCVNKETETRPVNGEWGPWEPYSSCSRTCGGGIESATRRCNRPEPRNGGNYCVGRRMKFRSCNTDSCPKGTQDFREKQCSDFNGKHLDISGIPSNVRWLPRYSGIGTKDRCKLYCQVAGTNYFYLLKDMVEDGTPCGTETHDICVQGQCMAAGCDHVLNSSAKIDKCGVCGGDNSSCKTITGVFNSSHYGYNVVVKIPAGATNVDIRQYSYSGQPDDSYLALSDAEGNFLFNGNFLLSTSKKEINVQGTRTVIEYSGSNNAVERINSTNRQEKELILQVLCVGNLYNPDVHYSFNIPLEERSDMFTWDPYGPWEGCTKMCQGLQRRNITCIHKSDHSVVSDKECDHLPLPSFVTQSCNTDCELRWHVIGKSECSSQCGQGYRTLDIHCMKYSIHEGQTVQVDDHYCGDQLKPPTQELCHGNCVFTRWHYSEWSQCSRSCGGGERSRESYCMNNFGHRLADNECQELSRVTRENCNEFSCPSWAASEWSECLVTCGKGTKQRQVWCQLNVDHLSDGFCNSSTKPESLSPCELHTCASWQVGPWGPCTTTCGHGYQMRDVKCVNELASAVLEDTECHEASRPSDRQSCVLTPCSFISKLETALLPTVLIKKMAQWRHGSWTPCSVSCGRGTQARYVSCRDALDRIADESYCAHLPRPAEIWDCFTPCGEWQAGDWSPCSASCGHGKTTRQVLCMNYHQPIDENYCDPEVRPLMEQECSLAACPPAHSHFPSSPVQPSYYLSTNLPLTQKLEDNENQVVHPSVRGNQWRTGPWGSCSSSCSGGLQHRAVVCQDENGQSASYCDAASKPPELQQCGPGPCPQWNYGNWGECSQTCGGGIKSRLVICQFPNGQILEDHNCEIVNKPPSVIQCHMHACPADVSWHQEPWTSEDLKVKLLPQRTIILWELMKNIFCHGKHSHMYLINVVTDHLLYPRHCDPETIETYFLSLWSLQFTWGDLKYYKNSL

SEQ ID NO: 2302 - protein, 1205 aa, Homo sapiens
  Payload ID: 569;
  Gene Symbol: ADAMTS3;
  Gene Name: ADAM metallopeptidase with thrombospondin type 1 motif, 3;
  Uniprot ID:  O15072;
  ENSP ID: ENSP00000286657
MVLLSLWLIAAALVEVRTSADGQAGNEEMVQIDLPIKRYREYELVTPVSTNLEGRYLSHTLSASHKKRSARDVSSNPEQLFFNITAFGKDFHLRLKPNTQLVAPGAVVEWHETSLVPGNITDPINNHQPGSATYRIRRTEPLQTNCAYVGDIVDIPGTSVAISNCDGLAGMIKSDNEEYFIEPLERGKQMEEEKGRIHVVYKRSAVEQAPIDMSKDFHYRESDLEGLDDLGTVYGNIHQQLNETMRRRRHAGENDYNIEVLLGVDDSVVRFHGKEHVQNYLLTLMNIVNEIYHDESLGVHINVVLVRMIMLGYAKSISLIERGNPSRSLENVCRWASQQQRSDLNHSEHHDHAIFLTRQDFGPAGMQGYAPVTGMCHPVRSCTLNHEDGFSSAFVVAHETGHVLGMEHDGQGNRCGDETAMGSVMAPLVQAAFHRYHWSRCSGQELKRYIHSYDCLLDDPFDHDWPKLPELPGINYSMDEQCRFDFGVGYKMCTAFRTFDPCKQLWCSHPDNPYFCKTKKGPPLDGTECAAGKWCYKGHCMWKNANQQKQDGNWGSWTKFGSCSRTCGTGVRFRTRQCNNPMPINGGQDCPGVNFEYQLCNTEECQKHFEDFRAQQCQQRNSHFEYQNTKHHWLPYEHPDPKKRCHLYCQSKETGDVAYMKQLVHDGTHCSYKDPYSICVRGECVKVGCDKEIGSNKVEDKCGVCGGDNSHCRTVKGTFTRTPRKLGYLKMFDIPPGARHVLIQEDEASPHILAIKNQATGHYILNGKGEEAKSRTFIDLGVEWDYNIEDDIESLHTDGPLHDPVIVLIIPQENDTRSSLTYKYIIHEDSVPTINSNNVIQEELDTFEWALKSWSQCSKPCGGGFQYTKYGCRRKSDNKMVHRSFCEANKKPKPIRRMCNIQECTHPLWVAEEWEHCTKTCGSSGYQLRTVRCLQPLLDGTNRSVHSKYCMGDRPESRRPCNRVPCPAQWKTGPWSECSVTCGEGTEVRQVLCRAGDHCDGEKPESVRACQLPPCNDEPCLGDKSIFCQMEVLARYCSIPGYNKLCCESCSKRSSTLPPPYLLEAAETHDDVISNPSDLPRSLVMPTSLVPYHSETPAKKMSLSSISSVGGPNAYAAFRPNSKPDGANLRQRSAQQAGSKTVRLVTVPSSPPTKRVHLSSASQMAAASFFAASDSIGASSQARTSKKDGKIIDNRRPTRSSTLER

SEQ ID NO: 2303 - protein, 1205 aa, Homo sapiens; identical to SEQ ID NO: 2302
  Payload ID: 569;
  Gene Symbol: ADAMTS3;
  Gene Name: ADAM metallopeptidase with thrombospondin type 1 motif, 3;
  Uniprot ID:  O15072;
  ENSP ID: ENSP00000480055

SEQ ID NO: 2304 - protein, 339 aa, Homo sapiens
  Payload ID: 570;
  Gene Symbol: ADAMTS4;
  Gene Name: ADAM metallopeptidase with thrombospondin type 1 motif, 4;
  ENSP ID: ENSP00000356974
MSQTGSHPGRGLAGRWLWGAQPCLLLPIVPLSWLVWLLLLLLASLLPSARLASPLPREEEIVFPEKLNGSVLPGSGAPARLLCRLQAFGETLLLELEQDSGVQVEGLTVQYLGQAPELLGGAEPGTYLTGTINGDPESVASLHWDGGALLGVLQYRGAELHLQPLEGGTPNSAGGPGAHILRRKSPASGQGPMCNVKAPLGSPSPRPRRAKRFASLSRFVETLVVADDKMAAFHGAGLKRYLLTVMAAAAKAFKHPSIRNPVSLVVTRLVILGSGEEGPQVGPSAAQTLRSFCAWQRGLNTPEDSDPDHFDTAILFTRQVRPQSAPQAMHCTILRSATT

SEQ ID NO: 2305 - protein, 837 aa, Homo sapiens
  Payload ID: 570;
  Gene Symbol: ADAMTS4;
  Gene Name: ADAM metallopeptidase with thrombospondin type 1 motif, 4;
  Uniprot ID:  O75173;
  ENSP ID: ENSP00000356975
MSQTGSHPGRGLAGRWLWGAQPCLLLPIVPLSWLVWLLLLLLASLLPSARLASPLPREEEIVFPEKLNGSVLPGSGAPARLLCRLQAFGETLLLELEQDSGVQVEGLTVQYLGQAPELLGGAEPGTYLTGTINGDPESVASLHWDGGALLGVLQYRGAELHLQPLEGGTPNSAGGPGAHILRRKSPASGQGPMCNVKAPLGSPSPRPRRAKRFASLSRFVETLVVADDKMAAFHGAGLKRYLLTVMAAAAKAFKHPSIRNPVSLVVTRLVILGSGEEGPQVGPSAAQTLRSFCAWQRGLNTPEDSDPDHFDTAILFTRQDLCGVSTCDTLGMADVGTVCDPARSCAIVEDDGLQSAFTAAHELGHVFNMLHDNSKPCISLNGPLSTSRHVMAPVMAHVDPEEPWSPCSARFITDFLDNGYGHCLLDKPEAPLHLPVTFPGKDYDADRQCQLTFGPDSRHCPQLPPPCAALWCSGHLNGHAMCQTKHSPWADGTPCGPAQACMGGRCLHMDQLQDFNIPQAGGWGPWGPWGDCSRTCGGGVQFSSRDCTRPVPRNGGKYCEGRRTRFRSCNTEDCPTGSALTFREEQCAAYNHRTDLFKSFPGPMDWVPRYTGVAPQDQCKLTCQAQALGYYYVLEPRVVDGTPCSPDSSSVCVQGRCIHAGCDRIIGSKKKFDKCMVCGGDGSGCSKQSGSFRKFRYGYNNVVTIPAGATHILVRQQGNPGHRSIYLALKLPDGSYALNGEYTLMPSPTDVVLPGAVSLRYSGATAASETLSGHGPLAQPLTLQVLVAGNPQDTRLRYSFFVPRPTPSTPRPTPQDWLHRRAQILEILRRRPWAGRK

SEQ ID NO: 2306 - protein, 930 aa, Homo sapiens
  Payload ID: 571;
  Gene Symbol: ADAMTS5;
  Gene Name: ADAM metallopeptidase with thrombospondin type 1 motif, 5;
  Uniprot ID:  Q9UNA0;
  ENSP ID: ENSP00000284987
MLLGWASLLLCAFRLPLAAVGPAATPAQDKAGQPPTAAAAAQPRRRQGEEVQERAEPPGHPHPLAQRRRSKGLVQNIDQLYSGGGKVGYLVYAGGRRFLLDLERDGSVGIAGFVPAGGGTSAPWRHRSHCFYRGTVDGSPRSLAVFDLCGGLDGFFAVKHARYTLKPLLRGPWAEEEKGRVYGDGSARILHVYTREGFSFEALPPRASCETPASTPEAHEHAPAHSNPSGRAALASQLLDQSALSPAGGSGPQTWWRRRRRSISRARQVELLLVADASMARLYGRGLQHYLLTLASIANRLYSHASIENHIRLAVVKVVVLGDKDKSLEVSKNAATTLKNFCKWQHQHNQLGDDHEEHYDAAILFTREDLCGHHSCDTLGMADVGTICSPERSCAVIEDDGLHAAFTVAHEIGHLLGLSHDDSKFCEETFGSTEDKRLMSSILTSIDASKPWSKCTSATITEFLDDGHGNCLLDLPRKQILGPEELPGQTYDATQQCNLTFGPEYSVCPGMDVCARLWCAVVRQGQMVCLTKKLPAVEGTPCGKGRICLQGKCVDKTKKKYYSTSSHGNWGSWGSWGQCSRSCGGGVQFAYRHCNNPAPRNNGRYCTGKRAIYRSCSLMPCPPNGKSFRHEQCEAKNGYQSDAKGVKTFVEWVPKYAGVLPADVCKLTCRAKGTGYYVVFSPKVTDGTECRLYSNSVCVRGKCVRTGCDGIIGSKLQYDKCGVCGGDNSSCTKIVGTFNKKSKGYTDVVRIPEGATHIKVRQFKAKDQTRFTAYLALKKKNGEYLINGKYMISTSETIIDINGTVMNYSGWSHRDDFLHGMGYSATKEILIVQILATDPTKPLDVRYSFFVPKKSTPKVNSVTSHGSNKVGSHTSQPQWVTGPWLACSRTCDTGWHTRTVQCQDGNRKLAKGCPLSQRPSAFKQCLLKKC

SEQ ID NO: 2307 - protein, 1117 aa, Homo sapiens
  Payload ID: 572;
  Gene Symbol: ADAMTS6;
  Gene Name: ADAM metallopeptidase with thrombospondin type 1 motif, 6;
  Uniprot ID:  Q9UKP5;
  ENSP ID: ENSP00000370443
MEILWKTLTWILSLIMASSEFHSDHRLSYSSQEEFLTYLEHYQLTIPIRVDQNGAFLSFTVKNDKHSRRRRSMDPIDPQQAVSKLFFKLSAYGKHFHLNLTLNTDFVSKHFTVEYWGKDGPQWKHDFLDNCHYTGYLQDQRSTTKVALSNCVGLHGVIATEDEEYFIEPLKNTTEDSKHFSYENGHPHVIYKKSALQQRHLYDHSHCGVSDFTRSGKPWWLNDTSTVSYSLPINNTHIHHRQKRSVSIERFVETLVVADKMMVGYHGRKDIEHYILSVMNIVAKLYRDSSLGNVVNIIVARLIVLTEDQPNLEINHHADKSLDSFCKWQKSILSHQSDGNTIPENGIAHHDNAVLITRYDICTYKNKPCGTLGLASVAGMCEPERSCSINEDIGLGSAFTIAHEIGHNFGMNHDGIGNSCGTKGHEAAKLMAAHITANTNPFSWSACSRDYITSFLDSGRGTCLDNEPPKRDFLYPAVAPGQVYDADEQCRFQYGATSRQCKYGEVCRELWCLSKSNRCVTNSIPAAEGTLCQTGNIEKGWCYQGDCVPFGTWPQSIDGGWGPWSLWGECSRTCGGGVSSSLRHCDSPAPSGGGKYCLGERKRYRSCNTDPCPLGSRDFREKQCADFDNMPFRGKYYNWKPYTGGGVKPCALNCLAEGYNFYTERAPAVIDGTQCNADSLDICINGECKHVGCDNILGSDAREDRCRVCGGDGSTCDAIEGFFNDSLPRGGYMEVVQIPRGSVHIEVREVAMSKNYIALKSEGDDYYINGAWTIDWPRKFDVAGTAFHYKRPTDEPESLEALGPTSENLIVMVLLQEQNLGIRYKFNVPITRTGSGDNEVGFTWNHQPWSECSATCAGGVQRQEVVCKRLDDNSIVQNNYCDPDSKPPENQRACNTEPCPPEWFIGDWLECSKTCDGGMRTRAVLCIRKIGPSEEETLDYSGCLTHRPVEKEPCNNQSCPPQWVALDWSECTPKCGPGFKHRIVLCKSSDLSKTFPAAQCPEESKPPVRIRCSLGRCPPPRWVTGDWGQCSAQCGLGQQMRTVQCLSYTGQASSDCLETVRPPSMQQCESKCDSTPISNTEECKDVNKVAYCPLVLKFKFCSRAYFRQMCCKTCQGH

SEQ ID NO: 2308 - protein, 292 aa, Homo sapiens
  Payload ID: 572;
  Gene Symbol: ADAMTS6;
  Gene Name: ADAM metallopeptidase with thrombospondin type 1 motif, 6;
  Uniprot ID:  Q9UKP5;
  ENSP ID: ENSP00000424377
MEILWKTLTWILSLIMASSEFHSDHRLSYSSQEEFLTYLEHYQLTIPIRVDQNGAFLSFTVKNDKHSRRRRSMDPIDPQQAVSKLFFKLSAYGKHFHLNLTLNTDFVSKHFTVEYWGKDGPQWKHDFLDNCHYTGYLQDQRSTTKVALSNCVGLHGVIATEDEEYFIEPLKNTTEDSKHFSYENGHPHVIYKKSALQQRHLYDHSHCGVSDFTRSGKPWWLNDTSTVSYSLPINNTHIHHRQKRSVSIERFVETLVVADKMMVGYHGRKDIEHYILSVMNIVRLPNFTVIPA

SEQ ID NO: 2309 - protein, 1686 aa, Homo sapiens
  Payload ID: 573;
  Gene Symbol: ADAMTS7;
  Gene Name: ADAM metallopeptidase with thrombospondin type 1 motif, 7;
  Uniprot ID:  Q9UKP4;
  ENSP ID: ENSP00000373472
MPGGPSPRSPAPLLRPLLLLLCALAPGAPGPAPGRATEGRAALDIVHPVRVDAGGSFLSYELWPRALRKRDVSVRRDAPAFYELQYRGRELRFNLTANQHLLAPGFVSETRRRGGLGRAHIRAHTPACHLLGEVQDPELEGGLAAISACDGLKGVFQLSNEDYFIEPLDSAPARPGHAQPHVVYKRQAPERLAQRGDSSAPSTCGVQVYPELESRRERWEQRQQWRRPRLRRLHQRSVSKEKWVETLVVADAKMVEYHGQPQVESYVLTIMNMVAGLFHDPSIGNPIHITIVRLVLLEDEEEDLKITHHADNTLKSFCKWQKSINMKGDAHPLHHDTAILLTRKDLCAAMNRPCETLGLSHVAGMCQPHRSCSINEDTGLPLAFTVAHELGHSFGIQHDGSGNDCEPVGKRPFIMSPQLLYDAAPLTWSRCSRQYITRFLDRGWGLCLDDPPAKDIIDFPSVPPGVLYDVSHQCRLQYGAYSAFCEDMDNVCHTLWCSVGTTCHSKLDAAVDGTRCGENKWCLSGECVPVGFRPEAVDGGWSGWSAWSICSRSCGMGVQSAERQCTQPTPKYKGRYCVGERKRFRLCNLQACPAGRPSFRHVQCSHFDAMLYKGQLHTWVPVVNDVNPCELHCRPANEYFAEKLRDAVVDGTPCYQVRASRDLCINGICKNVGCDFEIDSGAMEDRCGVCHGNGSTCHTVSGTFEEAEGLGYVDVGLIPAGAREIRIQEVAEAANFLALRSEDPEKYFLNGGWTIQWNGDYQVAGTTFTYARRGNWENLTSPGPTKEPVWIQLLFQESNPGVHYEYTIHREAGGHDEVPPPVFSWHYGPWTKCTVTCGRGVQRQNVYCLERQAGPVDEEHCDPLGRPDDQQRKCSEQPCPARWWAGEWQLCSSSCGPGGLSRRAVLCIRSVGLDEQSALEPPACEHLPRPPTETPCNRHVPCPATWAVGNWSQCSVTCGEGTQRRNVLCTNDTGVPCDEAQQPASEVTCSLPLCRWPLGTLGPEGSGSGSSSHELFNEADFIPHHLAPRPSPASSPKPGTMGNAIEEEAPELDLPGPVFVDDFYYDYNFINFHEDLSYGPSEEPDLDLAGTGDRTPPPHSHPAAPSTGSPVPATEPPAAKEEGVLGPWSPSPWPSQAGRSPPPPSEQTPGNPLINFLPEEDTPIGAPDLGLPSLSWPRVSTDGLQTPATPESQNDFPVGKDSQSQLPPPWRDRTNEVFKDDEEPKGRGAPHLPPRPSSTLPPLSPVGSTHSSPSPDVAELWTGGTVAWEPALEGGLGPVDSELWPTVGVASLLPPPIAPLPEMKVRDSSLEPGTPSFPTPGPGSWDLQTVAVWGTFLPTTLTGLGHMPEPALNPGPKGQPESLSPEVPLSSRLLSTPAWDSPANSHRVPETQPLAPSLAEAGPPADPLVVRNAGWQAGNWSECSTTCGLGAVWRPVRCSSGRDEDCAPAGRPQPARRCHLRPCATWHSGNWSKCSRSCGGGSSVRDVQCVDTRDLRPLRPFHCQPGPAKPPAHRPCGAQPCLSWYTSSWRECSEACGGGEQQRLVTCPEPGLCEEALRPNTTRPCNTHPCTQWVVGPWGQCSGPCGGGVQRRLVKCVNTQTGLPEEDSDQCGHEAWPESSRPCGTEDCEPVEPPRCERDRLSFGFCETLRLLGRCQLPTIRTQCCRSCSPPSHGAPSRGHQRVARR

SEQ ID NO: 2310 - protein, 889 aa, Homo sapiens
  Payload ID: 574;
  Gene Symbol: ADAMTS8;
  Gene Name: ADAM metallopeptidase with thrombospondin type 1 motif, 8;
  Uniprot ID:  Q9UP79;
  ENSP ID: ENSP00000257359
MLPAPAAPRWPPLLLLLLLLLPLARGAPARPAAGGQASELVVPTRLPGSAGELALHLSAFGKGFVLRLAPDDSFLAPEFKIERLGGSGRATGGERGLRGCFFSGTVNGEPESLAAVSLCRGLSGSFLLDGEEFTIQPQGAGGSLAQPHRLQRWGPAGARPLPRGPEWEVETGEGQRQERGDHQEDSEEESQEEEAEGASEPPPPLGATSRTKRFVSEARFVETLLVADASMAAFYGADLQNHILTLMSVAARIYKHPSIKNSINLMVVKVLIVEDEKWGPEVSDNGGLTLRNFCNWQRRFNQPSDRHPEHYDTAILLTRQNFCGQEGLCDTLGVADIGTICDPNKSCSVIEDEGLQAAHTLAHELGHVLSMPHDDSKPCTRLFGPMGKHHVMAPLFVHLNQTLPWSPCSAMYLTELLDGGHGDCLLDAPAAALPLPTGLPGRMALYQLDQQCRQIFGPDFRHCPNTSAQDVCAQLWCHTDGAEPLCHTKNGSLPWADGTPCGPGHLCSEGSCLPEEEVERPKPVADGGWAPWGPWGECSRTCGGGVQFSHRECKDPEPQNGGRYCLGRRAKYQSCHTEECPPDGKSFREQQCEKYNAYNYTDMDGNLLQWVPKYAGVSPRDRCKLFCRARGRSEFKVFEAKVIDGTLCGPETLAICVRGQCVKAGCDHVVDSPRKLDKCGVCGGKGNSCRKVSGSLTPTNYGYNDIVTIPAGATNIDVKQRSHPGVQNDGNYLALKTADGQYLLNGNLAISAIEQDILVKGTILKYSGSIATLERLQSFRPLPEPLTVQLLTVPGEVFPPKVKYTFFVPNDVDFSMQSSKERATTNIIQPLLHAQWVLGDWSECSSTCGAGWQRRTVECRDPSGQASATCNKALKPEDAKPCESQLCPL

SEQ ID NO: 2311 - protein, 1907 aa, Homo sapiens
  Payload ID: 575;
  Gene Symbol: ADAMTS9;
  Gene Name: ADAM metallopeptidase with thrombospondin type 1 motif, 9;
  Uniprot ID:  Q9P2N4;
  ENSP ID: ENSP00000295903
MQFVSWATLLTLLVRDLAEMGSPDAAAAVRKDRLHPRQVKLLETLSEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 2312 - protein, 991 aa, Homo sapiens
  Payload ID: 575;
  Gene Symbol: ADAMTS9;
  Gene Name: ADAM metallopeptidase with thrombospondin type 1 motif, 9;
  ENSP ID: ENSP00000417521
  MOD_RES (1)..(1): Any amino acid
XECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 2313 - protein, 1935 aa, Homo sapiens
  Payload ID: 575;
  Gene Symbol: ADAMTS9;
  Gene Name: ADAM metallopeptidase with thrombospondin type 1 motif, 9;
  Uniprot ID:  Q9P2N4;
  ENSP ID: ENSP00000418735
MQFVSWATLLTLLVRDLAEMGSPDAAAAVRKDRLHPRQVKLLETLSEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 2314 - protein, 488 aa, Homo sapiens
  Payload ID: 575;
  Gene Symbol: ADAMTS9;
  Gene Name: ADAM metallopeptidase with thrombospondin type 1 motif, 9;
  ENSP ID: ENSP00000419217
MQFVSWATLLTLLVRDLAEMGSPDAAAAVRKDRLHPRQVKLLETLSEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLE

SEQ ID NO: 2315 - protein, 69 aa, Homo sapiens
  Payload ID: 575;
  Gene Symbol: ADAMTS9;
  Gene Name: ADAM metallopeptidase with thrombospondin type 1 motif, 9;
  ENSP ID: ENSP00000478086
AKCPQGRFSINLYGTGLSLTESARWISQGNYAVSDIKKSPDGTRVVGKCGGYCGKCTPSSGTGLEVRVL

SEQ ID NO: 2316 - protein, 470 aa, Homo sapiens
  Payload ID: 576;
  Gene Symbol: ADAMDEC1;
  Gene Name: ADAM-like, decysin 1;
  Uniprot ID:  O15204;
  ENSP ID: ENSP00000256412
MLRGISQLPAVATMSWVLLPVLWLIVQTQAIAIKQTPELTLHEIVCPKKLHILHKREIKNNQTEKHGKEERYEPEVQYQMILNGEEIILSLQKTKHLLGPDYTETLYSPRGEEITTKPENMEHCYYKGNILNEKNSVASISTCDGLRGYFTHHHQRYQIKPLKSTDEKEHAVFTSNQEEQDPANHTCGVKSTDGKQGPIRISRSLKSPEKEDFLRAQKYIDLYLVLDNAFYKNYNENLTLIRSFVFDVMNLLNVIYNTIDVQVALVGMEIWSDGDKIKVVPSASTTFDNFLRWHSSNLGKKIHDHAQLLSGISFNNRRVGLAASNSLCSPSSVAVIEAKKKNNVALVGVMSHELGHVLGMPDVPFNTKCPSGSCVMNQYLSSKFPKDFSTSCRAHFERYLLSQKPKCLLQAPIPTNIMTTPVCGNHLLEVGEDCDCGSPKECTNLCCEALTCKLKPGTDCGGDAPNHTTE

SEQ ID NO: 2317 - protein, 391 aa, Homo sapiens
  Payload ID: 576;
  Gene Symbol: ADAMDEC1;
  Gene Name: ADAM-like, decysin 1;
  Uniprot ID:  O15204;
  ENSP ID: ENSP00000428993
MILNGEEIILSLQKTKHLLGPDYTETLYSPRGEEITTKPENMEHCYYKGNILNEKNSVASISTCDGLRGYFTHHHQRYQIKPLKSTDEKEHAVFTSNQEEQDPANHTCGVKSTDGKQGPIRISRSLKSPEKEDFLRAQKYIDLYLVLDNAFYKNYNENLTLIRSFVFDVMNLLNVIYNTIDVQVALVGMEIWSDGDKIKVVPSASTTFDNFLRWHSSNLGKKIHDHAQLLSGISFNNRRVGLAASNSLCSPSSVAVIEAKKKNNVALVGVMSHELGHVLGMPDVPFNTKCPSGSCVMNQYLSSKFPKDFSTSCRAHFERYLLSQKPKCLLQAPIPTNIMTTPVCGNHLLEVGEDCDCGSPKECTNLCCEALTCKLKPGTDCGGDAPNHTTE

SEQ ID NO: 2318 - protein, 41 aa, Homo sapiens
  Payload ID: 576;
  Gene Symbol: ADAMDEC1;
  Gene Name: ADAM-like, decysin 1;
  ENSP ID: ENSP00000431008
MLRGISQLPAVATMSWVLLPVLWLIVQTQASNCAWPKVSIQ

SEQ ID NO: 2319 - protein, 683 aa, Homo sapiens
  Payload ID: 577;
  Gene Symbol: ADAMTSL1;
  Gene Name: ADAMTS-like 1;
  Uniprot ID:  Q8N6G6;
  ENSP ID: ENSP00000276935
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPASDGYKQIMPYDLYHPLPRWEATPWTACSSSCGGGIQSRAVSCVEEDIQGHVTSVEEWKCMYTPKMPIAQPCNIFDCPKWLAQEWSPCTVTCGQGLRYRVVLCIDHRGMHTGGCSPKTKPHIKEECIVPTPCYKPKEKLPVEAKLPWFKQAQELEEGAAVSEEPSFIPEAWSACTVTCGVGTQVRIVRCQVLLSFSQSVADLPIDECEGPKPASQRACYAGPCSGEIPEFNPDETDGLFGGLQDFDELYDWEYEGFTKCSESCGGGVQEAVVSCLNKQTREPAEENLCVTSRRPPQLLKSCNLDPCPARSSIDSAWNACNVLC

SEQ ID NO: 2320 - protein, 525 aa, Homo sapiens
  Payload ID: 577;
  Gene Symbol: ADAMTSL1;
  Gene Name: ADAMTS-like 1;
  Uniprot ID:  Q8N6G6;
  ENSP ID: ENSP00000327887
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPASDGYKQIMPYDLYHPLPRWEATPWTACSSSCGGGIQSRAVSCVEEDIQGHVTSVEEWKCMYTPKMPIAQPCNIFDCPKWLAQEWSPCTVTCGQGLRYRVVLCIDHRGMHTGGCSPKTKPHIKEECIVPTPCYKPKEKLPVEAKLPWFKQAQELEEGAAVSEEPS

SEQ ID NO: 2321 - protein, 150 aa, Homo sapiens
  Payload ID: 577;
  Gene Symbol: ADAMTSL1;
  Gene Name: ADAMTS-like 1;
  ENSP ID: ENSP00000369911
TSPLGTQLVLDPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSR

SEQ ID NO: 2322 - protein, 463 aa, Homo sapiens
  Payload ID: 577;
  Gene Symbol: ADAMTSL1;
  Gene Name: ADAMTS-like 1;
  Uniprot ID:  Q8N6G6;
  ENSP ID: ENSP00000369918
MSGVFCFFFFFLGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLDPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSRWMVTSWSACTRSCGGGVQTRRVTCQKLKASGISTPVSNDMCTQVAKRPVDTQACNQQLCVEWAFSSWGQCNGPCIGPHLAVQHRQVFCQTRDGITLPSEQCSALPRPVSTQNCWSEACSVHWRVSLWTLCTATCGNYGFQSRRVECVHARTNKAVPEHLCSWGPRPANWQRCNITPCENMECRDTTRYCEKVKQLKLCQLSQFKSRCCGTCGKA

SEQ ID NO: 2323 - protein, 1762 aa, Homo sapiens
  Payload ID: 577;
  Gene Symbol: ADAMTSL1;
  Gene Name: ADAMTS-like 1;
  Uniprot ID:  Q8N6G6;
  ENSP ID: ENSP00000369921
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPASDGYKQIMPYDLYHPLPRWEATPWTACSSSCGGGIQSRAVSCVEEDIQGHVTSVEEWKCMYTPKMPIAQPCNIFDCPKWLAQEWSPCTVTCGQGLRYRVVLCIDHRGMHTGGCSPKTKPHIKEECIVPTPCYKPKEKLPVEAKLPWFKQAQELEEGAAVSEEPSFIPEAWSACTVTCGVGTQVRIVRCQVLLSFSQSVADLPIDECEGPKPASQRACYAGPCSGEIPEFNPDETDGLFGGLQDFDELYDWEYEGFTKCSESCGGGVQEAVVSCLNKQTREPAEENLCVTSRRPPQLLKSCNLDPCPARWEIGKWSPCSLTCGVGLQTRDVFCSHLLSREMNETVILADELCRQPKPSTVQACNRFNCPPAWYPAQWQPCSRTCGGGVQKREVLCKQRMADGSFLELPETFCSASKPACQQACKKDDCPSEWLLSDWTECSTSCGEGTQTRSAICRKMLKTGLSTVVNSTLCPPLPFSSSIRPCMLATCARPGRPSTKHSPHIAAARKVYIQTRRQRKLHFVVGGFAYLLPKTAVVLRCPARRVRKPLITWEKDGQHLISSTHVTVAPFGYLKIHRLKPSDAGVYTCSAGPAREHFVIKLIGGNRKLVARPLSPRSEEEVLAGRKGGPKEALQTHKHQNGIFSNGSKAEKRGLAANPGSRYDDLVSRLLEQGGWPGELLASWEAQDSAERNTTSEEDPGAEQVLLHLPFTMVTEQRRLDDILGNLSQQPEELRDLYSKHLVAQLAQEIFRSHLEHQDTLLKPSERRTSPVTLSPHKHVSGFSSSLRTSSTGDAGGGSRRPHRKPTILRKISAAQQLSASEVVTHLGQTVALASGTLSVLLHCEAIGHPRPTISWARNGEEVQFSDRILLQPDDSLQILAPVEADVGFYTCNATNALGYDSVSIAVTLAGKPLVKTSRMTVINTEKPAVTVDIGSTIKTVQGVNVTINCQVAGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLDPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSRWMVTSWSACTRSCGGGVQTRRVTCQKLKASGISTPVSNDMCTQVAKRPVDTQACNQQLCVEWAFSSWGQCNGPCIGPHLAVQHRQVFCQTRDGITLPSEQCSALPRPVSTQNCWSEACSVHWRVSLWTLCTATCGNYGFQSRRVECVHARTNKAVPEHLCSWGPRPANWQRCNITPCENMECRDTTRYCEKVKQLKLCQLSQFKSRCCGTCGKA

SEQ ID NO: 2324 - protein, 439 aa, Homo sapiens
  Payload ID: 577;
  Gene Symbol: ADAMTSL1;
  Gene Name: ADAMTS-like 1;
  Uniprot ID:  Q8N6G6;
  ENSP ID: ENSP00000369940
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPARWEATPWTACSSSCGGGIQSRAVSCVEEDIQGHVTSVEEWKCMYTPKMPIAQPCNIFDCPKWLAQEWSPVTVPSFFVH

SEQ ID NO: 2325 - protein, 219 aa, Homo sapiens
  Payload ID: 577;
  Gene Symbol: ADAMTSL1;
  Gene Name: ADAMTS-like 1;
  ENSP ID: ENSP00000369944
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKCKTHRDGRPLDLLTYPLLA

SEQ ID NO: 2326 - protein, 275 aa, Homo sapiens
  Payload ID: 577;
  Gene Symbol: ADAMTSL1;
  Gene Name: ADAMTS-like 1;
  ENSP ID: ENSP00000373362
MSGVFCFFFFFLGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLDPGNSALLGCPIKGHPVPNITWFHGGQPIVTATGLTHHILAAGQILQVANLSGGSQGEFSCLAQNEAGVLMQKASLVIQVQWALHRASPSCATQTSLLPDTGWHHLTIRAVQCSSEACEHPELLVRGLQCTLESQPVDPVHSYLWQLRLPVPACGVCACPHQQGSA

SEQ ID NO: 2327 - protein, 185 aa, Homo sapiens
  Payload ID: 577;
  Gene Symbol: ADAMTSL1;
  Gene Name: ADAMTS-like 1;
  ENSP ID: ENSP00000401157
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQVSADLFSFNLSRGFQCLCVNGLHSLTL

SEQ ID NO: 2328 - protein, 258 aa, Homo sapiens
  Payload ID: 577;
  Gene Symbol: ADAMTSL1;
  Gene Name: ADAMTS-like 1;
  Uniprot ID:  Q8N6G6;
  ENSP ID: ENSP00000440472
MSGVFCFFFFFLGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLDPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSRAMGLASGLT

SEQ ID NO: 2329 - protein, 951 aa, Homo sapiens
  Payload ID: 578;
  Gene Symbol: ADAMTSL2;
  Gene Name: ADAMTS-like 2;
  Uniprot ID:  Q86TH1;
  ENSP ID: ENSP00000346478
MDGRWQCSCWAWFLLVLAVVAGDTVSTGSTDNSPTSNSLEGGTDATAFWWGEWTKWTACSRSCGGGVTSQERHCLQQRRKSVPGPGNRTCTGTSKRYQLCRVQECPPDGRSFREEQCVSFNSHVYNGRTHQWKPLYPDDYVHISSKPCDLHCTTVDGQRQLMVPARDGTSCKLTDLRGVCVSGKCEPIGCDGVLFSTHTLDKCGICQGDGSSCTHVTGNYRKGNAHLGYSLVTHIPAGARDIQIVERKKSADVLALADEAGYYFFNGNYKVDSPKNFNIAGTVVKYRRPMDVYETGIEYIVAQGPTNQGLNVMVWNQNGKSPSITFEYTLLQPPHESRPQPIYYGFSESAESQGLDGAGLMGFVPHNGSLYGQASSERLGLDNRLFGHPGLDMELGPSQGQETNEVCEQAGGGACEGPPRGKGFRDRNVTGTPLTGDKDDEEVDTHFASQEFFSANAISDQLLGAGSDLKDFTLNETVNSIFAQGAPRSSLAESFFVDYEENEGAGPYLLNGSYLELSSDRVANSSSEAPFPNVSTSLLTSAGNRTHKARTRPKARKQGVSPADMYRWKLSSHEPCSATCTTGVMSAYAMCVRYDGVEVDDSYCDALTRPEPVHEFCAGRECQPRWETSSWSECSRTCGEGYQFRVVRCWKMLSPGFDSSVYSDLCEAAEAVRPEERKTCRNPACGPQWEMSEWSECTAKCGERSVVTRDIRCSEDEKLCDPNTRPVGEKNCTGPPCDRQWTVSDWGPCSGSCGQGRTIRHVYCKTSDGRVVPESQCQMETKPLAIHPCGDKNCPAHWLAQDWERCNTTCGRGVKKRLVLCMELANGKPQTRSGPECGLAKKPPEESTCFERPCFKWYTSPWSECTKTCGVGVRMRDVKCYQGTDIVRGCDPLVKPVGRQACDLQPCPTEPPDDSCQDQPGTNCALAIKVNLCGHWYYSKACCRSCRPPHS

SEQ ID NO: 2330 - protein, 951 aa, Homo sapiens; identical to SEQ ID NO: 2329
  Payload ID: 578;
  Gene Symbol: ADAMTSL2;
  Gene Name: ADAMTS-like 2;
  Uniprot ID:  Q86TH1;
  ENSP ID: ENSP00000376780

SEQ ID NO: 2331 - protein, 1060 aa, Homo sapiens
  Payload ID: 578;
  Gene Symbol: ADAMTSL2;
  Gene Name: ADAMTS-like 2;
  ENSP ID: ENSP00000376781
MLFEVGEGGGAGEEGKGRGRPGRSLCTHAAPARTAHLAPSALRSARPFLWEDNLLTRSQGLPDNHDQLVPDNLEAWALAGPRGLFPKRTLVIWKRIGAGLVVTVALLPRMDGRWQCSCWAWFLLVLAVVAGDTVSTGSTDNSPTSNSLEGGTDATAFWWGEWTKWTACSRSCGGGVTSQERHCLQQRRKSVPGPGNRTCTGTSKRYQLCRVQECPPDGRSFREEQCVSFNSHVYNGRTHQWKPLYPDDYVHISSKPCDLHCTTVDGQRQLMVPARDGTSCKLTDLRGVCVSGKCEPIGCDGVLFSTHTLDKCGICQGDGSSCTHVTGNYRKGNAHLGYSLVTHIPAGARDIQIVERKKSADVLALADEAGYYFFNGNYKVDSPKNFNIAGTVVKYRRPMDVYETGIEYIVAQGPTNQGLNVMVWNQNGKSPSITFEYTLLQPPHESRPQPIYYGFSESAESQGLDGAGLMGFVPHNGSLYGQASSERLGLDNRLFGHPGLDMELGPSQGQETNEVCEQAGGGACEGPPRGKGFRDRNVTGTPLTGDKDDEEVDTHFASQEFFSANAISDQLLGAGSDLKDFTLNETVNSIFAQGAPRSSLAESFFVDYEENEGAGPYLLNGSYLELSSDRVANSSSEAPFPNVSTSLLTSAGNRTHKARTRPKARKQGVSPADMYRWKLSSHEPCSATCTTGVMSAYAMCVRYDGVEVDDSYCDALTRPEPVHEFCAGRECQPRWETSSWSECSRTCGEGYQFRVVRCWKMLSPGFDSSVYSDLCEAAEAVRPEERKTCRNPACGPQWEMSEWSECTAKCGERSVVTRDIRCSEDEKLCDPNTRPVGEKNCTGPPCDRQWTVSDWGPCSGSCGQGRTIRHVYCKTSDGRVVPESQCQMETKPLAIHPCGDKNCPAHWLAQDWERCNTTCGRGVKKRLVLCMELANGKPQTRSGPECGLAKKPPEESTCFERPCFKWYTSPWSECTKTCGVGVRMRDVKCYQGTDIVRGCDPLVKPVGRQACDLQPCPTEPPDDSCQDQPGTNCALAIKVNLCGHWYYSKACCRSCRPPHS

SEQ ID NO: 2332 - protein, 1691 aa, Homo sapiens
  Payload ID: 579;
  Gene Symbol: ADAMTSL3;
  Gene Name: ADAMTS-like 3;
  Uniprot ID:  P82987;
  ENSP ID: ENSP00000286744
MASWTSPWWVLIGMVFMHSPLPQTTAEKSPGAYFLPEFALSPQGSFLEDTTGEQFLTYRYDDQTSRNTRSDEDKDGNWDAWGDWSDCSRTCGGGASYSLRRCLTGRNCEGQNIRYKTCSNHDCPPDAEDFRAQQCSAYNDVQYQGHYYEWLPRYNDPAAPCALKCHAQGQNLVVELAPKVLDGTRCNTDSLDMCISGICQAVGCDRQLGSNAKEDNCGVCAGDGSTCRLVRGQSKSHVSPEKREENVIAVPLGSRSVRITVKGPAHLFIESKTLQGSKGEHSFNSPGVFLVENTTVEFQRGSERQTFKIPGPLMADFIFKTRYTAAKDSVVQFFFYQPISHQWRQTDFFPCTVTCGGGYQLNSAECVDIRLKRVVPDHYCHYYPENVKPKPKLKECSMDPCPSSDGFKEIMPYDHFQPLPRWEHNPWTACSVSCGGGIQRRSFVCVEESMHGEILQVEEWKCMYAPKPKVMQTCNLFDCPKWIAMEWSQCTVTCGRGLRYRVVLCINHRGEHVGGCNPQLKLHIKEECVIPIPCYKPKEKSPVEAKLPWLKQAQELEETRIATEEPTFIPEPWSACSTTCGPGVQVREVKCRVLLTFTQTETELPEEECEGPKLPTERPCLLEACDESPASRELDIPLPEDSETTYDWEYAGFTPCTATCVGGHQEAIAVCLHIQTQQTVNDSLCDMVHRPPAMSQACNTEPCPPRWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKCSVSCGVGIQRRKQVCQRLAAKGRRIPLSEMMCRDLPGLPLVRSCQMPECSKIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKIILDGTGKIQIQNPTRKEQGIYECSVANHLGSDVESSSVLYAEAPVILSVERNITKPEHNHLSVVVGGIVEAALGANVTIRCPVKGVPQPNITWLKRGGSLSGNVSLLFNGSLLLQNVSLENEGTYVCIATNALGKAVATSVLHLLERRWPESRIVFLQGHKKYILQATNTRTNSNDPTGEPPPQEPFWEPGNWSHCSATCGHLGARIQRPQCVMANGQEVSEALCDHLQKPLAGFEPCNIRDCPARWFTSVWSQCSVSCGEGYHSRQVTCKRTKANGTVQVVSPRACAPKDRPLGRKPCFGHPCVQWEPGNRCPGRCMGRAVRMQQRHTACQHNSSDSNCDDRKRPTLRRNCTSGACDVCWHTGPWKPCTAACGRGFQSRKVDCIHTRSCKPVAKRHCVQKKKPISWRHCLGPSCDRDCTDTTHYCMFVKHLNLCSLDRYKQRCCQSCQEG

SEQ ID NO: 2333 - protein, 1682 aa, Homo sapiens
  Payload ID: 579;
  Gene Symbol: ADAMTSL3;
  Gene Name: ADAMTS-like 3;
  Uniprot ID:  P82987;
  ENSP ID: ENSP00000456313
MASWTSPWWVLIGMVFMHSPLPQTTAEKSPGAYFLPEFALSPQGSFLEDTTGEQFLTYRYDDQTSRNTRSDEDKDGNWDAWGDWSDCSRTCGGGASYSLRRCLTGRNCEGQNIRYKTCSNHDCPPDAEDFRAQQCSAYNDVQYQGHYYEWLPRYNDPAAPCALKCHAQGQNLVVELAPKVLDGTRCNTDSLDMCISGICQAVGCDRQLGSNAKEDNCGVCAGDGSTCRLVRGQSKSHVSPEKREENVIAVPLGSRSVRITVKGPAHLFIESKTLQGSKGEHSFNSPGVFLVENTTVEFQRGSERQTFKIPGPLMADFIFKTRYTAAKDSVVQFFFYQPISHQWRQTDFFPCTVTCGGGYQLNSAECVDIRLKRVVPDHYCHYYPENVKPKPKLKECSMDPCPSSDGFKEIMPYDHFQPLPRWEHNPWTACSVSCGGGIQRRSFVCVEESMHGEILQVEEWKCMYAPKPKVMQTCNLFDCPKWIAMEWSQCTVTCGRGLRYRVVLCINHRGEHVGGCNPQLKLHIKEECVIPIPCYKPKEKSPVEAKLPWLKQAQELEETRIATEEPTFIPEPWSACSTTCGPGVQVREVKCRVLLTFTQTETELPEEECEGPKLPTERPCLLEACDESPASRELDIPLPEDSETTYDWEYAGFTPCTATCVGGHQEAIAVCLHIQTQQTVNDSLCDMVHRPPAMSQACNTEPCPPRWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKCSVSCGVGIQRRKQVCQRLAAKGRRIPLSEMMCRDLPGLPLVRSCQMPECSKIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKIILDGTGKIQIQNPTRKEQGIYECSVANHLGSDVESSSVLYAEAPVILSVERNITKPEHNHLSVVVGGIVEAALGANVTIRCPVKGVPQPNITWLKRGGSLSGNVSLLFNGSLLLQNVSLENEGTYVCIATNALGKAVATSVLHLLERRWPESRIVFLQGHKKYILQATNTRTNSNDPTGEPPPQEPFWEPGNWSHCSATCGHLGARIQRPQCVMANGQEVSEALCDHLQKPLAGFEPCNIRDCPARWFTSVWSQCSVSCGEGYHSRQVTCKRTKANGTVQVVSPRACAPKDRPLGRKPCFGHPCVQWEPGNRCPGRCMGRAVRMQQRHTACQHNSSDSNCDDRKRPTLRRNCTSGACDVCWHTGPWKPCTAACGRGFQSRKVDCIHTRSCKPVAKRHCVQKKKPISWRHCLGPSCDSTYTSQTATNKGAASHVKRDKPLEGS

SEQ ID NO: 2334 - protein, 1074 aa, Homo sapiens
  Payload ID: 580;
  Gene Symbol: ADAMTSL4;
  Gene Name: ADAMTS-like 4;
  Uniprot ID:  Q6UY14;
  ENSP ID: ENSP00000271643
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRPPDMRACSLGPCERTWRWYTGPWGECSSECGSGTQRRDIICVSKLGTEFNVTSPSNCSHLPRPPALQPCQGQACQDRWFSTPWSPCSRSCQGGTQTREVQCLSTNQTLSTRCPPQLRPSRKRPCNSQPCSQRPDDQCKDSSPHCPLVVQARLCVYPYYTATCCRSCAHVLERSPQDPS

SEQ ID NO: 2335 - protein, 1074 aa, Homo sapiens; identical to SEQ ID NO: 2334
  Payload ID: 580;
  Gene Symbol: ADAMTSL4;
  Gene Name: ADAMTS-like 4;
  Uniprot ID:  Q6UY14;
  ENSP ID: ENSP00000358034

SEQ ID NO: 2336 - protein, 1097 aa, Homo sapiens
  Payload ID: 580;
  Gene Symbol: ADAMTSL4;
  Gene Name: ADAMTS-like 4;
  Uniprot ID:  Q6UY14;
  ENSP ID: ENSP00000358035
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEAPLLPLRHAFFLLPGAGSGDSTGVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRPPDMRACSLGPCERTWRWYTGPWGECSSECGSGTQRRDIICVSKLGTEFNVTSPSNCSHLPRPPALQPCQGQACQDRWFSTPWSPCSRSCQGGTQTREVQCLSTNQTLSTRCPPQLRPSRKRPCNSQPCSQRPDDQCKDSSPHCPLVVQARLCVYPYYTATCCRSCAHVLERSPQDPS

SEQ ID NO: 2337 - protein, 877 aa, Homo sapiens
  Payload ID: 580;
  Gene Symbol: ADAMTSL4;
  Gene Name: ADAMTS-like 4;
  Uniprot ID:  Q6UY14;
  ENSP ID: ENSP00000358037
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKVSPEPPAISCILGNHAQDTSAFPA

SEQ ID NO: 2338 - protein, 435 aa, Homo sapiens
  Payload ID: 580;
  Gene Symbol: ADAMTSL4;
  Gene Name: ADAMTS-like 4;
  ENSP ID: ENSP00000477897
MGSLALAGVLMAVESVGVMILPVALFRGTSLTEGAPWAIRRSCGFQREPCGSRLPSSGLAPTTWHFVALGAGPINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRP

SEQ ID NO: 2339 - protein, 471 aa, Homo sapiens
  Payload ID: 581;
  Gene Symbol: ADAMTSL5;
  Gene Name: ADAMTS-like 5;
  ENSP ID: ENSP00000327608
MDSAPLFPRPHLFQNLLLFLWALLNCGLGVSAQGPGEWTPWVSWTRCSSSCGRGVSVRSRRCLRLPGEEPCWGDSHEYRLCQLPDCPPGAVPFRDLQCALYNGRPVLGTQKTYQWVPFHGAPNQCDLNCLAEGHAFYHSFGRVLDGTACSPGAQGVCVAGRCLSAGCDGLLGSGALEDRCGRCGGANDSCLFVQRVFRDAGAFAGYWNVTLIPEGARHIRVEHRSRNHLALMGGDGRYVLNGHWVVSPPGTYEAAGTHVVYTRDTGPQETLQAAGPTSHDLLLQVLLQEPNPGIEFEFWLPRERYSPFQARVQALGWPLRQPQPRGVEPQPPAAPAVTPAQTPTLAPDPCPPCPDTRGRAHRLLHYCGSDFVFQARVLGHHHQAQETRYEVRIQLVYKNRSPLRAREYVWAPGHCPCPMLAPHRDYLMAVQRLVSPDGTQDQLLLPHAGYARPWSPAEDSRIRLTARRCPG

SEQ ID NO: 2340 - protein, 131 aa, Homo sapiens
  Payload ID: 581;
  Gene Symbol: ADAMTSL5;
  Gene Name: ADAMTS-like 5;
  ENSP ID: ENSP00000378850
MGGDGRYVLNGHWVVSPPGTYEAAGTHVVYTRDTGPQETLQAAGPTSHDLLLQVLLQEPNPGIEFEFWLPRERYSPFQARVQALGWPLRQPQPRGVEPQPPAAPAVTPAQTPTLAPGPSAGPPPPGPGDPL

SEQ ID NO: 2341 - protein, 135 aa, Homo sapiens
  Payload ID: 581;
  Gene Symbol: ADAMTSL5;
  Gene Name: ADAMTS-like 5;
  ENSP ID: ENSP00000466231
RHIRVEHRSRNHLGILGSLMGGDGRYVLNGHWVVSPPGTYEAAGTHVVYTRDTGPQETLQAAGPTSHDLLLQVLLQEPNPGIEFEFWLPRERYSPFQARVQALGWPLRQPQPRGVEPQPPAAPAVTPAQTPTLAP

SEQ ID NO: 2342 - protein, 141 aa, Homo sapiens
  Payload ID: 581;
  Gene Symbol: ADAMTSL5;
  Gene Name: ADAMTS-like 5;
  ENSP ID: ENSP00000479786
MGKLRPGRVEWLASGHTERPHLFQNLLLFLWALLNCGLGVSAQGPGEWTPWVSWTRCSSSCGRGVSVRSRRCLRLPGEEPCWGDSHEYRLCQLPDCPPGAVPFRDLQCALYNGRPVLGTQKTYQWVPFHGAPNQCDLNCLA

SEQ ID NO: 2343 - protein, 210 aa, Homo sapiens
  Payload ID: 581;
  Gene Symbol: ADAMTSL5;
  Gene Name: ADAMTS-like 5;
  ENSP ID: ENSP00000482683
MGKLRPGRVEWLASGHTERPHLFQNLLLFLWALLNCGLGVSAQGPGEWTPWVSWTRCSSSCGRGVSVRSRRCLRLPGEEPCWGDSHEYRLCQLPDCPPGAVPFRDLQCALYNGRPVLGTQKTYQWVPFHGAPNQCDLNCLAEGHAFYHSFGRVLDGTACSPGAQGVCVAGRCLSAGCDGLLGSGALEDRCGRCGGANDSCLFVQRVFRDA

SEQ ID NO: 2344 - protein, 130 aa, Homo sapiens
  Payload ID: 581;
  Gene Symbol: ADAMTSL5;
  Gene Name: ADAMTS-like 5;
  ENSP ID: ENSP00000484344
MGKLRPGRVEWLASGHTERPHLFQNLLLFLWALLNCGLGVSAQGPGEWTPWVSWTRCSSSCGRGVSVRSRRCLRLPGEEPCWGDSHEYRLCQLPDCPPGAVPFRDLQCALYNGRPVLGTQKTYQWVPFHG

SEQ ID NO: 2345 - protein, 709 aa, Homo sapiens
  Payload ID: 582;
  Gene Symbol: APPL1;
  Gene Name: adaptor prt, phosphotyr interaction, PH domain and leu zipper containing 1;
  Uniprot ID:  Q9UKG1;
  ENSP ID: ENSP00000288266
MPGIDKLPIEETLEDSPQTRSLLGVFEEDATAISNYMNQLYQAMHRIYDAQNELSAATHLTSKLLKEYEKQRFPLGGDDEVMSSTLQQFSKVIDELSSCHAVLSTQLADAMMFPITQFKERDLKEILTLKEVFQIASNDHDAAINRYSRLSKKRENDKVKYEVTEDVYTSRKKQHQTMMHYFCALNTLQYKKKIALLEPLLGYMQAQISFFKMGSENLNEQLEEFLANIGTSVQNVRREMDSDIETMQQTIEDLEVASDPLYVPDPDPTKFPVNRNLTRKAGYLNARNKTGLVSSTWDRQFYFTQGGNLMSQARGDVAGGLAMDIDNCSVMAVDCEDRRYCFQITSFDGKKSSILQAESKKDHEEWICTINNISKQIYLSENPEETAARVNQSALEAVTPSPSFQQRHESLRPAAGQSRPPTARTSSSGSLGSESTNLAALSLDSLVAPDTPIQFDIISPVCEDQPGQAKAFGQGGRRTNPFGESGGSTKSETEDSILHQLFIVRFLGSMEVKSDDHPDVVYETMRQILAARAIHNIFRMTESHLLVTCDCLKLIDPQTQVTRLTFPLPCVVLYATHQENKRLFGFVLRTSSGRSESNLSSVCYIFESNNEGEKICDSVGLAKQIALHAELDRRASEKQKEIERVKEKQQKELNKQKQIEKDLEEQSRLIAASSRPNQASSEGQFVVLSSSQSEESDLGEGGKKRESEA

SEQ ID NO: 2346 - protein, 133 aa, Homo sapiens
  Payload ID: 582;
  Gene Symbol: APPL1;
  Gene Name: adaptor prt, phosphotyr interaction, PH domain and leu zipper containing 1;
  ENSP ID: ENSP00000406095
MTRSLLGVFEEDATAISNYMNQLYQAMHRIYDAQNELSAATHLTSKLLKEYEKQRFPLGGDDEVMSSTLQQFSKVIDELSSCHAVLSTQLADAMMFPITQFKERDLKEILTLKEVFQIASNDHDAAINRYSRL

SEQ ID NO: 2347 - protein, 114 aa, Homo sapiens
  Payload ID: 582;
  Gene Symbol: APPL1;
  Gene Name: adaptor prt, phosphotyr interaction, PH domain and leu zipper containing 1;
  ENSP ID: ENSP00000419644
MPGIDKLPIEETLEDSPQTRSLLGVFEEDATAISNYMNQLYQAMHRIYDAQNELSAATHLTSKLLKEYEKQLSSCHAVLSTQLADAMMFPITQFKERDLKEILTLKEVFQIASN

SEQ ID NO: 2348 - protein, 664 aa, Homo sapiens
  Payload ID: 583;
  Gene Symbol: APPL2;
  Gene Name: adaptor prt, phosphotyr interaction, PH domain and leu zipper containing 2;
  Uniprot ID:  Q8NEU8;
  ENSP ID: ENSP00000258530
MPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSRRTNPFGETEDESFPEAEDSLLQQMFIVRFLGSMAVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEHRGAESEA

SEQ ID NO: 2349 - protein, 621 aa, Homo sapiens
  Payload ID: 583;
  Gene Symbol: APPL2;
  Gene Name: adaptor prt, phosphotyr interaction, PH domain and leu zipper containing 2;
  Uniprot ID:  Q8NEU8;
  ENSP ID: ENSP00000444472
MQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSRRTNPFGETEDESFPEAEDSLLQQMFIVRFLGSMAVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEHRGAESEA

SEQ ID NO: 2350 - protein, 188 aa, Homo sapiens
  Payload ID: 583;
  Gene Symbol: APPL2;
  Gene Name: adaptor prt, phosphotyr interaction, PH domain and leu zipper containing 2;
  ENSP ID: ENSP00000446510
DIVLPATEFLDQNRGSRRTNPFGETEDESFPEAEVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEH

SEQ ID NO: 2351 - protein, 670 aa, Homo sapiens
  Payload ID: 583;
  Gene Symbol: APPL2;
  Gene Name: adaptor prt, phosphotyr interaction, PH domain and leu zipper containing 2;
  Uniprot ID:  Q8NEU8;
  ENSP ID: ENSP00000446917
MPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNDVCLFLEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSRRTNPFGETEDESFPEAEDSLLQQMFIVRFLGSMAVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEHRGAESEA

SEQ ID NO: 2352 - protein, 61 aa, Homo sapiens
  Payload ID: 583;
  Gene Symbol: APPL2;
  Gene Name: adaptor prt, phosphotyr interaction, PH domain and leu zipper containing 2;
  ENSP ID: ENSP00000447520
MQRVYGAQNEMCLATQQLSKQLLAYEKQNFALGKGDEEVISTLHYFSKVVDELNLLHTELA

SEQ ID NO: 2353 - protein, 107 aa, Homo sapiens
  Payload ID: 583;
  Gene Symbol: APPL2;
  Gene Name: adaptor prt, phosphotyr interaction, PH domain and leu zipper containing 2;
  ENSP ID: ENSP00000447828
MSLLQPGPVFPSGNSENSDLTVLPNHICSKILSFSTFANHYFSCLLQICYAINLGKEIIEVQKDPEALAQLMLSIPLTNDGKYVLLNDQPDDDDGNPNEHRGAESEA

SEQ ID NO: 2354 - protein, 39 aa, Homo sapiens
  Payload ID: 583;
  Gene Symbol: APPL2;
  Gene Name: adaptor prt, phosphotyr interaction, PH domain and leu zipper containing 2;
  ENSP ID: ENSP00000448569
MVLPIIQFREKDLTEVSTLKDLFGLASNAGCLRKRRMRR

SEQ ID NO: 2355 - protein, 235 aa, Homo sapiens
  Payload ID: 583;
  Gene Symbol: APPL2;
  Gene Name: adaptor prt, phosphotyr interaction, PH domain and leu zipper containing 2;
  ENSP ID: ENSP00000449410
MPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQR

SEQ ID NO: 2356 - protein, 144 aa, Homo sapiens
  Payload ID: 583;
  Gene Symbol: APPL2;
  Gene Name: adaptor prt, phosphotyr interaction, PH domain and leu zipper containing 2;
  ENSP ID: ENSP00000449767
MPAVDKLLLEEALQDSPQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLS

SEQ ID NO: 2357 - protein, 302 aa, Homo sapiens
  Payload ID: 584;
  Gene Symbol: AP1AR;
  Gene Name: adaptor-related prt complex 1 associated regulatory prt;
  Uniprot ID:  Q63HQ0;
  ENSP ID: ENSP00000274000
MGNCCWTQCFGLLRKEAGRLQRVGGGGGSKYFRTCSRGEHLTIEFENLVESDEGESPGSSHRPLTEEEIVDLRERHYDSIAEKQKDLDKKIQKELALQEEKLRLEEEALYAAQREAARAAKQRKLLEQERQRIVQQYHPSNNGEYQSSGPEDDFESCLRNMKSQYEVFRSSRLSSDATVLTPNTESSCDLMTKTKSTSGNDDSTSLDLEWEDEEGMNRMLPMRERSKTEEDILRAALKYSNKKTGSNPTSASDDSNGLEWENDFVSAEMDDNGNSEYSGFVNPVLELSDSGIRHSDTDQQTR

SEQ ID NO: 2358 - protein, 269 aa, Homo sapiens
  Payload ID: 584;
  Gene Symbol: AP1AR;
  Gene Name: adaptor-related prt complex 1 associated regulatory prt;
  Uniprot ID:  Q63HQ0;
  ENSP ID: ENSP00000309023
MGNCCWTQCFGLLRKEAGRLQRVGGGGGSKYFRTCSRGEHLTIEFENLVESDEGESPGSSHRPLTEEEIVDLRERHYDSIAEKQKDLDKKIQKEQERQRIVQQYHPSNNGEYQSSGPEDDFESCLRNMKSQYEVFRSSRLSSDATVLTPNTESSCDLMTKTKSTSGNDDSTSLDLEWEDEEGMNRMLPMRERSKTEEDILRAALKYSNKKTGSNPTSASDDSNGLEWENDFVSAEMDDNGNSEYSGFVNPVLELSDSGIRHSDTDQQTR

SEQ ID NO: 2359 - protein, 76 aa, Homo sapiens
  Payload ID: 584;
  Gene Symbol: AP1AR;
  Gene Name: adaptor-related prt complex 1 associated regulatory prt;
  ENSP ID: ENSP00000422529
  MOD_RES (1)..(1): Any amino acid
XGEYQSSGPEDDFESCLRNMKSQYEVFRSSRLSSDATVLTPNTESSCDLMTKTKSTSGNDDSTSLDLEWEDEEGIL

SEQ ID NO: 2360 - protein, 919 aa, Homo sapiens
  Payload ID: 585;
  Gene Symbol: AP1B1;
  Gene Name: adaptor-related prt complex 1, beta 1 subunit;
  Uniprot ID:  Q10567;
  ENSP ID: ENSP00000319361
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLIGGTNFVAPPTAAVPANLGAPIGSGLSDLFDLTSGVGTLSGSYVAPKAVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTLSLKCRAPEVSQHVYQAYETILKN

SEQ ID NO: 2361 - protein, 949 aa, Homo sapiens
  Payload ID: 585;
  Gene Symbol: AP1B1;
  Gene Name: adaptor-related prt complex 1, beta 1 subunit;
  Uniprot ID:  Q10567;
  ENSP ID: ENSP00000350199
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLMGDEPEGIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTDLELSLKCRAPEVSQHVYQAYETILKN

SEQ ID NO: 2362 - protein, 949 aa, Homo sapiens; identical to SEQ ID NO: 2361
  Payload ID: 585;
  Gene Symbol: AP1B1;
  Gene Name: adaptor-related prt complex 1, beta 1 subunit;
  Uniprot ID:  Q10567;
  ENSP ID: ENSP00000384194

SEQ ID NO: 2363 - protein, 939 aa, Homo sapiens
  Payload ID: 585;
  Gene Symbol: AP1B1;
  Gene Name: adaptor-related prt complex 1, beta 1 subunit;
  Uniprot ID:  Q10567;
  ENSP ID: ENSP00000386071
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTLSLKCRAPEVSQHVYQAYETILKN

SEQ ID NO: 2364 - protein, 939 aa, Homo sapiens; identical to SEQ ID NO: 2363
  Payload ID: 585;
  Gene Symbol: AP1B1;
  Gene Name: adaptor-related prt complex 1, beta 1 subunit;
  Uniprot ID:  Q10567;
  ENSP ID: ENSP00000387612

SEQ ID NO: 2365 - protein, 173 aa, Homo sapiens
  Payload ID: 585;
  Gene Symbol: AP1B1;
  Gene Name: adaptor-related prt complex 1, beta 1 subunit;
  ENSP ID: ENSP00000392735
  MOD_RES (1)..(1): Any amino acid
XDIMIRLASQANIAQAPASSLPWAFYLEQEAESHSPRESVYIHCPGVFQQIAPSGAPAPSFLFGPQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERID

SEQ ID NO: 2366 - protein, 578 aa, Homo sapiens
  Payload ID: 585;
  Gene Symbol: AP1B1;
  Gene Name: adaptor-related prt complex 1, beta 1 subunit;
  ENSP ID: ENSP00000400022
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPP

SEQ ID NO: 2367 - protein, 939 aa, Homo sapiens; identical to SEQ ID NO: 2363
  Payload ID: 585;
  Gene Symbol: AP1B1;
  Gene Name: adaptor-related prt complex 1, beta 1 subunit;
  Uniprot ID:  Q10567;
  ENSP ID: ENSP00000400065

SEQ ID NO: 2368 - protein, 822 aa, Homo sapiens
  Payload ID: 586;
  Gene Symbol: AP1G1;
  Gene Name: adaptor-related prt complex 1, gamma 1 subunit;
  Uniprot ID:  O43747;
  ENSP ID: ENSP00000299980
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKLVPQLVRILKNLIMSGYSPEHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGAPAAAPAPASVPQISQPPFLLDGLSSQPLFNDIAAGIPSITAYSKNGLKIEFTFERSNTNPSVTVITIQASNSTELDMTDFVFQAAVPKTFQLQLLSPSSSIVPAFNTGTITQVIKVLNPQKQQLRMRIKLTYNHKGSAMQDLAEVNNFPPQSWQ

SEQ ID NO: 2369 - protein, 825 aa, Homo sapiens
  Payload ID: 586;
  Gene Symbol: AP1G1;
  Gene Name: adaptor-related prt complex 1, gamma 1 subunit;
  Uniprot ID:  O43747;
  ENSP ID: ENSP00000377148
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKNEKLVPQLVRILKNLIMSGYSPEHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGAPAAAPAPASVPQISQPPFLLDGLSSQPLFNDIAAGIPSITAYSKNGLKIEFTFERSNTNPSVTVITIQASNSTELDMTDFVFQAAVPKTFQLQLLSPSSSIVPAFNTGTITQVIKVLNPQKQQLRMRIKLTYNHKGSAMQDLAEVNNFPPQSWQ

SEQ ID NO: 2370 - protein, 176 aa, Homo sapiens
  Payload ID: 586;
  Gene Symbol: AP1G1;
  Gene Name: adaptor-related prt complex 1, gamma 1 subunit;
  ENSP ID: ENSP00000405836
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKEMIYKQTNVTGYILGGIPNS

SEQ ID NO: 2371 - protein, 247 aa, Homo sapiens
  Payload ID: 586;
  Gene Symbol: AP1G1;
  Gene Name: adaptor-related prt complex 1, gamma 1 subunit;
  ENSP ID: ENSP00000454219
MRSALLERMPVMEKVTTNGPTEIVQTNGETEPAPLETKPPPSGPQPTSQANDLLDLLGGNDITPVIPTAPTSKPSSAGGELLDLLGDINLTGAPAAAPAPASVPQISQPPFLLDGLSSQPLFNDIAAGIPSITAYSKNGLKIEFTFERSNTNPSVTVITIQASNSTELDMTDFVFQAAVPKTFQLQLLSPSSSIVPAFNTGTITQVIKVLNPQKQQLRMRIKLTYNHKGSAMQDLAEVNNFPPQSWQ

SEQ ID NO: 2372 - protein, 822 aa, Homo sapiens; identical to SEQ ID NO: 2368
  Payload ID: 586;
  Gene Symbol: AP1G1;
  Gene Name: adaptor-related prt complex 1, gamma 1 subunit;
  Uniprot ID:  O43747;
  ENSP ID: ENSP00000454523

SEQ ID NO: 2373 - protein, 144 aa, Homo sapiens
  Payload ID: 586;
  Gene Symbol: AP1G1;
  Gene Name: adaptor-related prt complex 1, gamma 1 subunit;
  ENSP ID: ENSP00000454713
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEK

SEQ ID NO: 2374 - protein, 53 aa, Homo sapiens
  Payload ID: 586;
  Gene Symbol: AP1G1;
  Gene Name: adaptor-related prt complex 1, gamma 1 subunit;
  ENSP ID: ENSP00000454717
MPAPIRLRELIRTIRTARTQAEEREMIQKECAAIRSSFREEDNTYRCRNVAKL

SEQ ID NO: 2375 - protein, 58 aa, Homo sapiens
  Payload ID: 586;
  Gene Symbol: AP1G1;
  Gene Name: adaptor-related prt complex 1, gamma 1 subunit;
  ENSP ID: ENSP00000454932
SEAMNDILAQVATNTETSKNVGNAILYETVLTIMDIKSESGLRICGSDIFVEDCTDRS

SEQ ID NO: 2376 - protein, 236 aa, Homo sapiens
  Payload ID: 586;
  Gene Symbol: AP1G1;
  Gene Name: adaptor-related prt complex 1, gamma 1 subunit;
  ENSP ID: ENSP00000454970
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKVACAPISSYFKEPHHVRIFTRT

SEQ ID NO: 2377 - protein, 26 aa, Homo sapiens
  Payload ID: 586;
  Gene Symbol: AP1G1;
  Gene Name: adaptor-related prt complex 1, gamma 1 subunit;
  ENSP ID: ENSP00000455400
MPAPIRLRELIRTIRTARTQAEEREM

SEQ ID NO: 2378 - protein, 187 aa, Homo sapiens
  Payload ID: 586;
  Gene Symbol: AP1G1;
  Gene Name: adaptor-related prt complex 1, gamma 1 subunit;
  ENSP ID: ENSP00000456058
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKN

SEQ ID NO: 2379 - protein, 139 aa, Homo sapiens
  Payload ID: 586;
  Gene Symbol: AP1G1;
  Gene Name: adaptor-related prt complex 1, gamma 1 subunit;
  ENSP ID: ENSP00000456316
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLA

SEQ ID NO: 2380 - protein, 85 aa, Homo sapiens
  Payload ID: 586;
  Gene Symbol: AP1G1;
  Gene Name: adaptor-related prt complex 1, gamma 1 subunit;
  ENSP ID: ENSP00000456493
MPAPIRLRELIRTIRTARTQAEEREMIQKECAAIRSSFREEDNTYRCRNVAKLLYMHMLGYPAHFGQLECLKLIASQKFTDKRIG

SEQ ID NO: 2381 - protein, 208 aa, Homo sapiens
  Payload ID: 586;
  Gene Symbol: AP1G1;
  Gene Name: adaptor-related prt complex 1, gamma 1 subunit;
  ENSP ID: ENSP00000457726
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGNVIWMTCLFMRHSSIFTVF

SEQ ID NO: 2382 - protein, 91 aa, Homo sapiens
  Payload ID: 586;
  Gene Symbol: AP1G1;
  Gene Name: adaptor-related prt complex 1, gamma 1 subunit;
  ENSP ID: ENSP00000457927
MPAPIRLRELIRTIRTARTQAEEREMIQKECAAIRSSFREEDNTYRCRNVAKLLYMHMLGYPAHFGQLECLKLIASQKFTDKRIGYLGAML

SEQ ID NO: 2383 - protein, 785 aa, Homo sapiens
  Payload ID: 587;
  Gene Symbol: AP1G2;
  Gene Name: adaptor-related prt complex 1, gamma 2 subunit;
  Uniprot ID:  O75843;
  ENSP ID: ENSP00000312442
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKNDLSQGIQPVQGLALCTLSTMGSAEMCRDLAPEVEKLLLQPSPYVRKKAILTAVHMIRKVPELSSVFLPPCAQLLHERHHGILLGTITLITELCERSPAALRHFRKVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 2384 - protein, 785 aa, Homo sapiens; identical to SEQ ID NO: 2383
  Payload ID: 587;
  Gene Symbol: AP1G2;
  Gene Name: adaptor-related prt complex 1, gamma 2 subunit;
  Uniprot ID:  O75843;
  ENSP ID: ENSP00000380309

SEQ ID NO: 2385 - protein, 143 aa, Homo sapiens
  Payload ID: 587;
  Gene Symbol: AP1G2;
  Gene Name: adaptor-related prt complex 1, gamma 2 subunit;
  ENSP ID: ENSP00000450588
  MOD_RES (1)..(1): Any amino acid
XAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERHHPACADNGGHPCAG

SEQ ID NO: 2386 - protein, 197 aa, Homo sapiens
  Payload ID: 587;
  Gene Symbol: AP1G2;
  Gene Name: adaptor-related prt complex 1, gamma 2 subunit;
  ENSP ID: ENSP00000450805
EEVLALLEKVLQSHMSLPATRGYALTALMKLSTRLCGDNKAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPA

SEQ ID NO: 2387 - protein, 68 aa, Homo sapiens
  Payload ID: 587;
  Gene Symbol: AP1G2;
  Gene Name: adaptor-related prt complex 1, gamma 2 subunit;
  ENSP ID: ENSP00000450888
MVVPSLKLQDLIEEIRGAKTQAQEREVIQKECAHIRASFRDGDPVHRHRQLAKLLYVHMLGYPAHFGQ

SEQ ID NO: 2388 - protein, 68 aa, Homo sapiens; identical to SEQ ID NO: 2387
  Payload ID: 587;
  Gene Symbol: AP1G2;
  Gene Name: adaptor-related prt complex 1, gamma 2 subunit;
  ENSP ID: ENSP00000451343

SEQ ID NO: 2389 - protein, 136 aa, Homo sapiens
  Payload ID: 587;
  Gene Symbol: AP1G2;
  Gene Name: adaptor-related prt complex 1, gamma 2 subunit;
  ENSP ID: ENSP00000451504
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKNDLSQGIQPVQGLALCTLSTMGSAEMC

SEQ ID NO: 2390 - protein, 200 aa, Homo sapiens
  Payload ID: 587;
  Gene Symbol: AP1G2;
  Gene Name: adaptor-related prt complex 1, gamma 2 subunit;
  ENSP ID: ENSP00000452153
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKNDLSQGIQPVQGLALCTLSTMGSAEMCRDLAPEVEKLLLQPSPYVRKKAILTAVHMIRKVPELSSVFLPPCAQLLHERHHGILLGTITLIT

SEQ ID NO: 2391 - protein, 423 aa, Homo sapiens
  Payload ID: 588;
  Gene Symbol: AP1M1;
  Gene Name: adaptor-related prt complex 1, mu 1 subunit;
  Uniprot ID:  Q9BXS5;
  ENSP ID: ENSP00000291439
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLVSANGNVLRSEIVGSIKMRVFLSGMPELRLGLNDKVLFDNTGRGKSKSVELEDVKFHQCVRLSRFENDRTISFIPPDGEFELMSYRLNTHVKPLIWIESVIEKHSHSRIEYMIKAKSQFKRRSTANNVEIHIPVPNDADSPKFKTTVGSVKWVPENSEIVWSIKSFPGGKEYLMRAHFGLPSVEAEDKEGKPPISVKFEIPYFTTSGIQVRYLKIIEKSGYQALPWVRYITQNGDYQLRTQ

SEQ ID NO: 2392 - protein, 435 aa, Homo sapiens
  Payload ID: 588;
  Gene Symbol: AP1M1;
  Gene Name: adaptor-related prt complex 1, mu 1 subunit;
  Uniprot ID:  Q9BXS5;
  ENSP ID: ENSP00000388996
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLGKYPGVGWLGHTVSANGNVLRSEIVGSIKMRVFLSGMPELRLGLNDKVLFDNTGRGKSKSVELEDVKFHQCVRLSRFENDRTISFIPPDGEFELMSYRLNTHVKPLIWIESVIEKHSHSRIEYMIKAKSQFKRRSTANNVEIHIPVPNDADSPKFKTTVGSVKWVPENSEIVWSIKSFPGGKEYLMRAHFGLPSVEAEDKEGKPPISVKFEIPYFTTSGIQVRYLKIIEKSGYQALPWVRYITQNGDYQLRTQ

SEQ ID NO: 2393 - protein, 370 aa, Homo sapiens
  Payload ID: 588;
  Gene Symbol: AP1M1;
  Gene Name: adaptor-related prt complex 1, mu 1 subunit;
  ENSP ID: ENSP00000411498
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLVSANGNVLRSEIVGSIKMRVFLSGMPELRLGLNDKVLFDNTGRGKSKSVELEDVKFHQCVRLSRFENDRTISFIPPDGEFELMSYRLNTHVKPLIWIESVIEKHSHSRIEYMIKGGKEYLMRAHFGLPSVEAEDKEGKPPISVKFEIPYFTTSGIQVRYLKIIEKSGYQALPWVRYITQNGDYQLRTQ

SEQ ID NO: 2394 - protein, 351 aa, Homo sapiens
  Payload ID: 588;
  Gene Symbol: AP1M1;
  Gene Name: adaptor-related prt complex 1, mu 1 subunit;
  ENSP ID: ENSP00000465224
MSASAVYVLDLKGKVLRVFSEYFKELEEESIRDNFVIIYELLDELMDFGYPQTTDSKILQEYITQEGHKLETGAPRPPATVTNAVSWRSEGIKYRKNEVFLDVIESVNLLVSANGNVLRSEIVGSIKMRVFLSGMPELRLGLNDKVLFDNTGRGKSKSVELEDVKFHQCVRLSRFENDRTISFIPPDGEFELMSYRLNTHVKPLIWIESVIEKHSHSRIEYMIKAKSQFKRRSTANNVEIHIPVPNDADSPKFKTTVGSVKWVPENSEIVWSIKSFPGGKEYLMRAHFGLPSVEAEDKEGKPPISVKFEIPYFTTSGIQVRYLKIIEKSGYQALPWVRYITQNGDYQLRTQ

SEQ ID NO: 2395 - protein, 136 aa, Homo sapiens
  Payload ID: 588;
  Gene Symbol: AP1M1;
  Gene Name: adaptor-related prt complex 1, mu 1 subunit;
  ENSP ID: ENSP00000466858
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYIT

SEQ ID NO: 2396 - protein, 125 aa, Homo sapiens
  Payload ID: 588;
  Gene Symbol: AP1M1;
  Gene Name: adaptor-related prt complex 1, mu 1 subunit;
  ENSP ID: ENSP00000467417
MSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPA

SEQ ID NO: 2397 - protein, 64 aa, Homo sapiens
  Payload ID: 588;
  Gene Symbol: AP1M1;
  Gene Name: adaptor-related prt complex 1, mu 1 subunit;
  ENSP ID: ENSP00000467721
MSEVEHFMPILMEKEEEGMLSPILAHGGVRFMWIKHNNLYLVATSKKNACVSLVFSFLYKVVQV

SEQ ID NO: 2398 - protein, 176 aa, Homo sapiens
  Payload ID: 588;
  Gene Symbol: AP1M1;
  Gene Name: adaptor-related prt complex 1, mu 1 subunit;
  ENSP ID: ENSP00000468015
  MOD_RES (1)..(1): Any amino acid
XSRFENDRTISFIPPDGEFELMSYRLNTHVKPLIWIESVIEKHSHSRIEYMIKAKSQFKRRSTANNVEIHIPVPNDADSPKFKTTVGSVKWVPENSEIVWSIKSFPGGKEYLMRAHFGLPSVEAEDKEGKPPISVKFEIPYFTTSGIQMLSLSQISIDPPGEVGFGERRQPQTFSH

SEQ ID NO: 2399 - protein, 105 aa, Homo sapiens
  Payload ID: 588;
  Gene Symbol: AP1M1;
  Gene Name: adaptor-related prt complex 1, mu 1 subunit;
  ENSP ID: ENSP00000468140
MSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKIL

SEQ ID NO: 2400 - protein, 128 aa, Homo sapiens
  Payload ID: 588;
  Gene Symbol: AP1M1;
  Gene Name: adaptor-related prt complex 1, mu 1 subunit;
  ENSP ID: ENSP00000482949
NLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLVGLFSFLLL

SEQ ID NO: 2401 - protein, 423 aa, Homo sapiens
  Payload ID: 589;
  Gene Symbol: AP1M2;
  Gene Name: adaptor-related prt complex 1, mu 2 subunit;
  Uniprot ID:  Q9Y6Q5;
  ENSP ID: ENSP00000250244
MSASAVFILDVKGKPLISRNYKGDVAMSKIEHFMPLLVQREEEGALAPLLSHGQVHFLWIKHSNLYLVATTSKNANASLVYSFLYKTIEVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVLFELTGRSKNKSVELEDVKFHQCVRLSRFDNDRTISFIPPDGDFELMSYRLSTQVKPLIWIESVIEKFSHSRVEIMVKAKGQFKKQSVANGVEISVPVPSDADSPRFKTSVGSAKYVPERNVVIWSIKSFPGGKEYLMRAHFGLPSVEKEEVEGRPPIGVKFEIPYFTVSGIQVRYMKIIEKSGYQALPWVRYITQSGDYQLRTS

SEQ ID NO: 2402 - protein, 245 aa, Homo sapiens
  Payload ID: 589;
  Gene Symbol: AP1M2;
  Gene Name: adaptor-related prt complex 1, mu 2 subunit;
  ENSP ID: ENSP00000465193
AVFILDVKGKVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVLFELTGRSKNKSVELEDVKFHQCVRLSRFDNDRTISFIPPDGDFELMSYRLSTQVKPLIWIESVIEKFSHSRVEIMVKAKGQFKKQSVANGVEISVPVPSDADSPR

SEQ ID NO: 2403 - protein, 44 aa, Homo sapiens
  Payload ID: 589;
  Gene Symbol: AP1M2;
  Gene Name: adaptor-related prt complex 1, mu 2 subunit;
  ENSP ID: ENSP00000465488
  MOD_RES (1)..(1): Any amino acid
XNVVIWSIKSFPVRYMKIIEKSGYQALPWVRYITQSGDYQLRTS

SEQ ID NO: 2404 - protein, 425 aa, Homo sapiens
  Payload ID: 589;
  Gene Symbol: AP1M2;
  Gene Name: adaptor-related prt complex 1, mu 2 subunit;
  Uniprot ID:  Q9Y6Q5;
  ENSP ID: ENSP00000465685
MSASAVFILDVKGKPLISRNYKGDVAMSKIEHFMPLLVQREEEGALAPLLSHGQVHFLWIKHSNLYLVATTSKNANASLVYSFLYKTIEVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVLFELTGLSGSKNKSVELEDVKFHQCVRLSRFDNDRTISFIPPDGDFELMSYRLSTQVKPLIWIESVIEKFSHSRVEIMVKAKGQFKKQSVANGVEISVPVPSDADSPRFKTSVGSAKYVPERNVVIWSIKSFPGGKEYLMRAHFGLPSVEKEEVEGRPPIGVKFEIPYFTVSGIQVRYMKIIEKSGYQALPWVRYITQSGDYQLRTS

SEQ ID NO: 2405 - protein, 128 aa, Homo sapiens
  Payload ID: 589;
  Gene Symbol: AP1M2;
  Gene Name: adaptor-related prt complex 1, mu 2 subunit;
  ENSP ID: ENSP00000465865
EISVPVPSDADSPRFKTSVGSAKYVPERNVVIWSIKSFPGGKEYLMRAHFGLPSVEKEEVEGRPPIGVKFEIPYFTVSGIQVRYMKIIEKSGYQALPWVRYITQSGGWERNSLCFPRPWSFPHPPDFI

SEQ ID NO: 2406 - protein, 299 aa, Homo sapiens
  Payload ID: 589;
  Gene Symbol: AP1M2;
  Gene Name: adaptor-related prt complex 1, mu 2 subunit;
  ENSP ID: ENSP00000466494
MSASAVFILDVKGKPLISRNYKGDVAMSKIEHFMPLLVQREEEGALAPLLSHGQVHFLWIKHSNLYCIHPTWCPWRWVWGLSAMVAAQAKRGWAEDRSCTAHLCGLGWGAGAGRDEGGGKGQGGGSGSVFHLLLHKWHLFLNLAAPVVATTSKNANASLVYSFLYKTIEVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVL

SEQ ID NO: 2407 - protein, 38 aa, Homo sapiens
  Payload ID: 589;
  Gene Symbol: AP1M2;
  Gene Name: adaptor-related prt complex 1, mu 2 subunit;
  ENSP ID: ENSP00000467406
MSASAVFILDVKGKRDPAMLPKLVSNSWPQGILLPWSS

SEQ ID NO: 2408 - protein, 239 aa, Homo sapiens
  Payload ID: 589;
  Gene Symbol: AP1M2;
  Gene Name: adaptor-related prt complex 1, mu 2 subunit;
  ENSP ID: ENSP00000467498
MSKIEHFMPLLVQREEEGALAPLLSHGQVHFLWIKHSNLYLVATTSKNANASLVYSFLYKTIEVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVLFELTGRSKNKSVELEDVKFHQCVRLSRFDNDRTISFIPPDGDFELM

SEQ ID NO: 2409 - protein, 103 aa, Homo sapiens
  Payload ID: 589;
  Gene Symbol: AP1M2;
  Gene Name: adaptor-related prt complex 1, mu 2 subunit;
  ENSP ID: ENSP00000468260
FKTSVGSAKYVPERNVVIWSIKSFPGGKEYLMRAHFGLPSVEKEEVEGRPPIGVKFEIPYFTVSGIQVRYMKIIEKSGYQALPWVRYITQSGGKAAQLLGTMG

SEQ ID NO: 2410 - protein, 158 aa, Homo sapiens
  Payload ID: 590;
  Gene Symbol: AP1S1;
  Gene Name: adaptor-related prt complex 1, sigma 1 subunit;
  Uniprot ID:  P61966;
  ENSP ID: ENSP00000336666
MMRFMLLFSRQGKLRLQKWYLATSDKERKKMVRELMQVVLARKPKMCSFLEWRDLKVVYKRYASLYFCCAIEGQDNELITLELIHRYVELLDKYFGSVCELDIIFNFEKAYFILDEFLMGGDVQDTSKKSVLKAIEQADLLQEEDESPRSVLEEMGLA

SEQ ID NO: 2411 - protein, 191 aa, Homo sapiens
  Payload ID: 590;
  Gene Symbol: AP1S1;
  Gene Name: adaptor-related prt complex 1, sigma 1 subunit;
  ENSP ID: ENSP00000399902
  MOD_RES (1)..(1): Any amino acid
XAKREGRGKRGAWAAPAGVLGGRPRGEPPCLPSGPQRPPLPRRMRFMLLFSRQGKLRLQKWYLATSDKERKKMVRELMQVVLARKPKMCSFLEWRDLKVVYKRYASLYFCCAIEGQDNELITLELIHRYVELLDKYFGSVCELDIIFNFEKAYFILDEFLMGGDVQDTSKKSVLKAIEQADLLQEEDESPR

SEQ ID NO: 2412 - protein, 158 aa, Homo sapiens; identical to SEQ ID NO: 2410
  Payload ID: 590;
  Gene Symbol: AP1S1;
  Gene Name: adaptor-related prt complex 1, sigma 1 subunit;
  Uniprot ID:  P61966;
  ENSP ID: ENSP00000410780

SEQ ID NO: 2413 - protein, 157 aa, Homo sapiens
  Payload ID: 591;
  Gene Symbol: AP1S2;
  Gene Name: adaptor-related prt complex 1, sigma 2 subunit;
  Uniprot ID:  P56377;
  ENSP ID: ENSP00000328789
MQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEEAETPRSVLEEIGLT

SEQ ID NO: 2414 - protein, 160 aa, Homo sapiens
  Payload ID: 591;
  Gene Symbol: AP1S2;
  Gene Name: adaptor-related prt complex 1, sigma 2 subunit;
  ENSP ID: ENSP00000369645
MQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEKTETMYHSKSFIGFKKAY

SEQ ID NO: 2415 - protein, 146 aa, Homo sapiens
  Payload ID: 591;
  Gene Symbol: AP1S2;
  Gene Name: adaptor-related prt complex 1, sigma 2 subunit;
  ENSP ID: ENSP00000389474
  MOD_RES (1)..(1): Any amino acid
XRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEPRHEYFNVPVY

SEQ ID NO: 2416 - protein, 153 aa, Homo sapiens
  Payload ID: 591;
  Gene Symbol: AP1S2;
  Gene Name: adaptor-related prt complex 1, sigma 2 subunit;
  ENSP ID: ENSP00000403498
  MOD_RES (1)..(1): Any amino acid
XLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQESQNEEWGGLSEDIL

SEQ ID NO: 2417 - protein, 160 aa, Homo sapiens
  Payload ID: 591;
  Gene Symbol: AP1S2;
  Gene Name: adaptor-related prt complex 1, sigma 2 subunit;
  ENSP ID: ENSP00000444957
MQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEDAKEAETPRSVLEEIGLT

SEQ ID NO: 2418 - protein, 81 aa, Homo sapiens
  Payload ID: 592;
  Gene Symbol: AP1S3;
  Gene Name: adaptor-related prt complex 1, sigma 3 subunit;
  ENSP ID: ENSP00000333888
MIHFILLFSRQGKLRLQKWYITLPDKERKKITREIVQIILSRGHRTSSFVDWKELKLVYKRSVSWILSLILKRLISSWTSL

SEQ ID NO: 2419 - protein, 63 aa, Homo sapiens
  Payload ID: 592;
  Gene Symbol: AP1S3;
  Gene Name: adaptor-related prt complex 1, sigma 3 subunit;
  ENSP ID: ENSP00000379890
MIHFILLFSRQGKLRLQKWYITLPDKERKKITREIVQIILSRGHRTSSFVDWKELKLVYKRCL

SEQ ID NO: 2420 - protein, 154 aa, Homo sapiens
  Payload ID: 592;
  Gene Symbol: AP1S3;
  Gene Name: adaptor-related prt complex 1, sigma 3 subunit;
  Uniprot ID:  Q96PC3;
  ENSP ID: ENSP00000379891
MIHFILLFSRQGKLRLQKWYITLPDKERKKITREIVQIILSRGHRTSSFVDWKELKLVYKRYASLYFCCAIENQDNELLTLEIVHRYVELLDKYFGNVCELDIIFNFEKAYFILDEFIIGGEIQETSKKIAVKAIEDSDMLQETMEEYMNKPTF

SEQ ID NO: 2421 - protein, 137 aa, Homo sapiens
  Payload ID: 592;
  Gene Symbol: AP1S3;
  Gene Name: adaptor-related prt complex 1, sigma 3 subunit;
  ENSP ID: ENSP00000387199
MIHFILLFSRQGKLRLQKWYITLPDKERKKITREIVQIILSRGHRTSSFVDWKELKLVYKRYASLYFCCAIENQDNELLTLEIVHRYVELLDKYFGNEFNCWFLLMRLLSVLDSWSTPALNSEVPQLATITPDFCLF

SEQ ID NO: 2422 - protein, 154 aa, Homo sapiens
  Payload ID: 592;
  Gene Symbol: AP1S3;
  Gene Name: adaptor-related prt complex 1, sigma 3 subunit;
  Uniprot ID:  Q96PC3;
  ENSP ID: ENSP00000388738
MIHFILLFSRQGKLRLQKWYITLPDKERKKITREIVQIILSRGHRTSSFVDWKELKLVYKRYASLYFCCAIENQDNELLTLEIVHRYVELLDKYFGNVCELDIIFNFEKAYFILDEFIIGGEIQETSKKIAVKAIEDSDMLQEVSTVSQTMGER

SEQ ID NO: 2423 - protein, 164 aa, Homo sapiens
  Payload ID: 592;
  Gene Symbol: AP1S3;
  Gene Name: adaptor-related prt complex 1, sigma 3 subunit;
  Uniprot ID:  Q96PC3;
  ENSP ID: ENSP00000397155
MIHFILLFSRQGKLRLQKWYITLPDKERKKITREIVQIILSRGHRTSSFVDWKELKLVYKRYASLYFCCAIENQDNELLTLEIVHRYVELLDKYFGNVCELDIIFNFEKAYFILDEFIIGGEIQETSKKIAVKAIEDSDMLQENRLSPRGRDCSEPRSCHCTLA

SEQ ID NO: 2424 - protein, 56 aa, Homo sapiens
  Payload ID: 592;
  Gene Symbol: AP1S3;
  Gene Name: adaptor-related prt complex 1, sigma 3 subunit;
  ENSP ID: ENSP00000399738
MISFLDEERLGGGGGDCIFVGKTVSRLLNVCELDIIFNFEKAYFILDEFIIGGEIQ

SEQ ID NO: 2425 - protein, 104 aa, Homo sapiens
  Payload ID: 592;
  Gene Symbol: AP1S3;
  Gene Name: adaptor-related prt complex 1, sigma 3 subunit;
  Uniprot ID:  Q96PC3;
  ENSP ID: ENSP00000401705
MIHFILLFSRQGKLRLQKWYITLPDKERKKITREIVQIILSRGHRTSSFVDWKELKLVYKRYASLYFCCAIENQDNELLTLEIVHRYVELLDKYFGNTWPFARA

SEQ ID NO: 2426 - protein, 955 aa, Homo sapiens
  Payload ID: 593;
  Gene Symbol: AP2A1;
  Gene Name: adaptor-related prt complex 2, alpha 1 subunit;
  Uniprot ID:  O95782;
  ENSP ID: ENSP00000346246
MPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 2427 - protein, 977 aa, Homo sapiens
  Payload ID: 593;
  Gene Symbol: AP2A1;
  Gene Name: adaptor-related prt complex 2, alpha 1 subunit;
  Uniprot ID:  O95782;
  ENSP ID: ENSP00000351926
MPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSELEPPAPESPMALLADPAPAADPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 2428 - protein, 57 aa, Homo sapiens
  Payload ID: 593;
  Gene Symbol: AP2A1;
  Gene Name: adaptor-related prt complex 2, alpha 1 subunit;
  ENSP ID: ENSP00000472492
  MOD_RES (1)..(1): Any amino acid
XPAVSKGDGMRGLAVFISDIRNCKSKEAEIKRINKELANIRSKFKGDKALDGYKEPR

SEQ ID NO: 2429 - protein, 940 aa, Homo sapiens
  Payload ID: 594;
  Gene Symbol: AP2A2;
  Gene Name: adaptor-related prt complex 2, alpha 2 subunit;
  Uniprot ID:  O94973;
  ENSP ID: ENSP00000327694
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPEDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 2430 - protein, 939 aa, Homo sapiens
  Payload ID: 594;
  Gene Symbol: AP2A2;
  Gene Name: adaptor-related prt complex 2, alpha 2 subunit;
  Uniprot ID:  O94973;
  ENSP ID: ENSP00000413234
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 2431 - protein, 656 aa, Homo sapiens
  Payload ID: 594;
  Gene Symbol: AP2A2;
  Gene Name: adaptor-related prt complex 2, alpha 2 subunit;
  Uniprot ID:  O94973;
  ENSP ID: ENSP00000431630
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPEDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVVCL

SEQ ID NO: 2432 - protein, 184 aa, Homo sapiens
  Payload ID: 594;
  Gene Symbol: AP2A2;
  Gene Name: adaptor-related prt complex 2, alpha 2 subunit;
  ENSP ID: ENSP00000433498
EFFLPRLVVTASGTPWFSSQCFPSGSSEGKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRT

SEQ ID NO: 2433 - protein, 90 aa, Homo sapiens
  Payload ID: 594;
  Gene Symbol: AP2A2;
  Gene Name: adaptor-related prt complex 2, alpha 2 subunit;
  ENSP ID: ENSP00000434432
MEAVNLLSSNRYTEKQIGYLFISVLVNSNSELIRLINNAIKNDLASRNPTFMGLALHCIASVGSREMAEAFAGEIPKVLVAGDTMDSVKQ

SEQ ID NO: 2434 - protein, 60 aa, Homo sapiens
  Payload ID: 594;
  Gene Symbol: AP2A2;
  Gene Name: adaptor-related prt complex 2, alpha 2 subunit;
  ENSP ID: ENSP00000434553
MEAVNLLSSNRYTEKQIGYLFISVLVNSNSELIRLINNAIKNDLASRNPTFMGLALHCIA

SEQ ID NO: 2435 - protein, 138 aa, Homo sapiens
  Payload ID: 594;
  Gene Symbol: AP2A2;
  Gene Name: adaptor-related prt complex 2, alpha 2 subunit;
  ENSP ID: ENSP00000434563
MLVQFFQRTLDSLLLLGKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMA

SEQ ID NO: 2436 - protein, 185 aa, Homo sapiens
  Payload ID: 594;
  Gene Symbol: AP2A2;
  Gene Name: adaptor-related prt complex 2, alpha 2 subunit;
  ENSP ID: ENSP00000435756
VRVWPRRIEEIACKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHL

SEQ ID NO: 2437 - protein, 62 aa, Homo sapiens
  Payload ID: 594;
  Gene Symbol: AP2A2;
  Gene Name: adaptor-related prt complex 2, alpha 2 subunit;
  ENSP ID: ENSP00000435863
MEAVNLLSSNRYTEKQIGYLFISVLVNSNSELIRLINNAIKNDLASRNPTFMGLALHCIASV

SEQ ID NO: 2438 - protein, 378 aa, Homo sapiens
  Payload ID: 594;
  Gene Symbol: AP2A2;
  Gene Name: adaptor-related prt complex 2, alpha 2 subunit;
  ENSP ID: ENSP00000436059
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDRCVGCLCTGSRCAQVRKPFLRDYVNCSQRSFSPEDGRPGSCVLCCLRLCRLSSWPSCR

SEQ ID NO: 2439 - protein, 125 aa, Homo sapiens
  Payload ID: 594;
  Gene Symbol: AP2A2;
  Gene Name: adaptor-related prt complex 2, alpha 2 subunit;
  ENSP ID: ENSP00000437228
MDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLET

SEQ ID NO: 2440 - protein, 356 aa, Homo sapiens
  Payload ID: 594;
  Gene Symbol: AP2A2;
  Gene Name: adaptor-related prt complex 2, alpha 2 subunit;
  ENSP ID: ENSP00000485693
  MOD_RES (1)..(1): Any amino acid
XKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDRCVGCLCTGSRCAQVRKPFLRDYVNCSQRSFSPEDGRPGSCVLCCLRLCRLSSWLSCR

SEQ ID NO: 2441 - protein, 90 aa, Homo sapiens; identical to SEQ ID NO: 2433
  Payload ID: 594;
  Gene Symbol: AP2A2;
  Gene Name: adaptor-related prt complex 2, alpha 2 subunit;
  ENSP ID: ENSP00000485814

SEQ ID NO: 2442 - protein, 90 aa, Homo sapiens; identical to SEQ ID NO: 2433
  Payload ID: 594;
  Gene Symbol: AP2A2;
  Gene Name: adaptor-related prt complex 2, alpha 2 subunit;
  ENSP ID: ENSP00000485960

SEQ ID NO: 2443 - protein, 634 aa, Homo sapiens
  Payload ID: 594;
  Gene Symbol: AP2A2;
  Gene Name: adaptor-related prt complex 2, alpha 2 subunit;
  ENSP ID: ENSP00000485977
  MOD_RES (1)..(1): Any amino acid
XKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPEDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVVCL

SEQ ID NO: 2444 - protein, 60 aa, Homo sapiens; identical to SEQ ID NO: 2434
  Payload ID: 594;
  Gene Symbol: AP2A2;
  Gene Name: adaptor-related prt complex 2, alpha 2 subunit;
  ENSP ID: ENSP00000486035

SEQ ID NO: 2445 - protein, 156 aa, Homo sapiens
  Payload ID: 594;
  Gene Symbol: AP2A2;
  Gene Name: adaptor-related prt complex 2, alpha 2 subunit;
  ENSP ID: ENSP00000486155
  MOD_RES (1)..(1): Any amino acid
XKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRT

SEQ ID NO: 2446 - protein, 173 aa, Homo sapiens
  Payload ID: 594;
  Gene Symbol: AP2A2;
  Gene Name: adaptor-related prt complex 2, alpha 2 subunit;
  ENSP ID: ENSP00000486169
  MOD_RES (1)..(1): Any amino acid
XKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHL

SEQ ID NO: 2447 - protein, 138 aa, Homo sapiens; identical to SEQ ID NO: 2435
  Payload ID: 594;
  Gene Symbol: AP2A2;
  Gene Name: adaptor-related prt complex 2, alpha 2 subunit;
  ENSP ID: ENSP00000486204

SEQ ID NO: 2448 - protein, 356 aa, Homo sapiens
  Payload ID: 594;
  Gene Symbol: AP2A2;
  Gene Name: adaptor-related prt complex 2, alpha 2 subunit;
  ENSP ID: ENSP00000486729
  MOD_RES (1)..(1): Any amino acid
XKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDRCVGCLCTGSRCAQVRKPFLRDYVNCSQRSFSPEDGRPGSCVLCCLRLCRLSSWPSCR

SEQ ID NO: 2449 - protein, 173 aa, Homo sapiens; identical to SEQ ID NO: 2446
  Payload ID: 594;
  Gene Symbol: AP2A2;
  Gene Name: adaptor-related prt complex 2, alpha 2 subunit;
  ENSP ID: ENSP00000486890
  MOD_RES (1)..(1): Any amino acid

SEQ ID NO: 2450 - protein, 138 aa, Homo sapiens; identical to SEQ ID NO: 2435
  Payload ID: 594;
  Gene Symbol: AP2A2;
  Gene Name: adaptor-related prt complex 2, alpha 2 subunit;
  ENSP ID: ENSP00000486895

SEQ ID NO: 2451 - protein, 62 aa, Homo sapiens; identical to SEQ ID NO: 2437
  Payload ID: 594;
  Gene Symbol: AP2A2;
  Gene Name: adaptor-related prt complex 2, alpha 2 subunit;
  ENSP ID: ENSP00000486964

SEQ ID NO: 2452 - protein, 125 aa, Homo sapiens; identical to SEQ ID NO: 2439
  Payload ID: 594;
  Gene Symbol: AP2A2;
  Gene Name: adaptor-related prt complex 2, alpha 2 subunit;
  ENSP ID: ENSP00000486996

SEQ ID NO: 2453 - protein, 140 aa, Homo sapiens
  Payload ID: 594;
  Gene Symbol: AP2A2;
  Gene Name: adaptor-related prt complex 2, alpha 2 subunit;
  ENSP ID: ENSP00000487022
AFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLET

SEQ ID NO: 2454 - protein, 917 aa, Homo sapiens
  Payload ID: 594;
  Gene Symbol: AP2A2;
  Gene Name: adaptor-related prt complex 2, alpha 2 subunit;
  ENSP ID: ENSP00000487149
  MOD_RES (1)..(1): Any amino acid
XKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 2455 - protein, 62 aa, Homo sapiens; identical to SEQ ID NO: 2437
  Payload ID: 594;
  Gene Symbol: AP2A2;
  Gene Name: adaptor-related prt complex 2, alpha 2 subunit;
  ENSP ID: ENSP00000487205

SEQ ID NO: 2456 - protein, 156 aa, Homo sapiens; identical to SEQ ID NO: 2445
  Payload ID: 594;
  Gene Symbol: AP2A2;
  Gene Name: adaptor-related prt complex 2, alpha 2 subunit;
  ENSP ID: ENSP00000487264
  MOD_RES (1)..(1): Any amino acid

SEQ ID NO: 2457 - protein, 634 aa, Homo sapiens; identical to SEQ ID NO: 2443
  Payload ID: 594;
  Gene Symbol: AP2A2;
  Gene Name: adaptor-related prt complex 2, alpha 2 subunit;
  ENSP ID: ENSP00000487282
  MOD_RES (1)..(1): Any amino acid

SEQ ID NO: 2458 - protein, 60 aa, Homo sapiens; identical to SEQ ID NO: 2434
  Payload ID: 594;
  Gene Symbol: AP2A2;
  Gene Name: adaptor-related prt complex 2, alpha 2 subunit;
  ENSP ID: ENSP00000487352

SEQ ID NO: 2459 - protein, 917 aa, Homo sapiens; identical to SEQ ID NO: 2454
  Payload ID: 594;
  Gene Symbol: AP2A2;
  Gene Name: adaptor-related prt complex 2, alpha 2 subunit;
  ENSP ID: ENSP00000487425
  MOD_RES (1)..(1): Any amino acid

SEQ ID NO: 2460 - protein, 164 aa, Homo sapiens
  Payload ID: 595;
  Gene Symbol: AP2B1;
  Gene Name: adaptor-related prt complex 2, beta 1 subunit;
  ENSP ID: ENSP00000464966
SEVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQLKK

SEQ ID NO: 2461 - protein, 80 aa, Homo sapiens
  Payload ID: 595;
  Gene Symbol: AP2B1;
  Gene Name: adaptor-related prt complex 2, beta 1 subunit;
  ENSP ID: ENSP00000465357
MTDSKYFTTNKKGEIFELKAELNNEKKEKRKEAVKKVIAAMTVGKDVSSLFPDVVNCMQTDNLELKKLVYLYLMNYAKSQ

SEQ ID NO: 2462 - protein, 63 aa, Homo sapiens
  Payload ID: 595;
  Gene Symbol: AP2B1;
  Gene Name: adaptor-related prt complex 2, beta 1 subunit;
  ENSP ID: ENSP00000465848
MTDSKYFTTNKKGEIFELKAELNNEKKEKRKEAVKKVIAAMTVGKDVRCCSSEVNFCYFSFVC

SEQ ID NO: 2463 - protein, 181 aa, Homo sapiens
  Payload ID: 595;
  Gene Symbol: AP2B1;
  Gene Name: adaptor-related prt complex 2, beta 1 subunit;
  ENSP ID: ENSP00000466580
DLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLPQKLFTVQFSSAYSEIERYPRNQDEKKLKPLFLLWIRMWLNIYSLRESRFLFREHHKEDLNLPVWKKMSF

SEQ ID NO: 2464 - protein, 132 aa, Homo sapiens
  Payload ID: 595;
  Gene Symbol: AP2B1;
  Gene Name: adaptor-related prt complex 2, beta 1 subunit;
  ENSP ID: ENSP00000466812
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKD

SEQ ID NO: 2465 - protein, 63 aa, Homo sapiens; identical to SEQ ID NO: 2462
  Payload ID: 595;
  Gene Symbol: AP2B1;
  Gene Name: adaptor-related prt complex 2, beta 1 subunit;
  ENSP ID: ENSP00000467382

SEQ ID NO: 2466 - protein, 151 aa, Homo sapiens
  Payload ID: 595;
  Gene Symbol: AP2B1;
  Gene Name: adaptor-related prt complex 2, beta 1 subunit;
  ENSP ID: ENSP00000468183
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDI

SEQ ID NO: 2467 - protein, 63 aa, Homo sapiens; identical to SEQ ID NO: 2462
  Payload ID: 595;
  Gene Symbol: AP2B1;
  Gene Name: adaptor-related prt complex 2, beta 1 subunit;
  ENSP ID: ENSP00000468813

SEQ ID NO: 2468 - protein, 677 aa, Homo sapiens
  Payload ID: 595;
  Gene Symbol: AP2B1;
  Gene Name: adaptor-related prt complex 2, beta 1 subunit;
  ENSP ID: ENSP00000478115
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLLGSDLGGGIGGSPA

SEQ ID NO: 2469 - protein, 663 aa, Homo sapiens
  Payload ID: 595;
  Gene Symbol: AP2B1;
  Gene Name: adaptor-related prt complex 2, beta 1 subunit;
  ENSP ID: ENSP00000478471
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSL

SEQ ID NO: 2470 - protein, 677 aa, Homo sapiens; identical to SEQ ID NO: 2468
  Payload ID: 595;
  Gene Symbol: AP2B1;
  Gene Name: adaptor-related prt complex 2, beta 1 subunit;
  ENSP ID: ENSP00000479691

SEQ ID NO: 2471 - protein, 49 aa, Homo sapiens
  Payload ID: 595;
  Gene Symbol: AP2B1;
  Gene Name: adaptor-related prt complex 2, beta 1 subunit;
  ENSP ID: ENSP00000481246
MTDSKYFTTNKKGEIFELKAELNNEKKEKRKEAVKKVIAAMTVGKDVST

SEQ ID NO: 2472 - protein, 639 aa, Homo sapiens
  Payload ID: 595;
  Gene Symbol: AP2B1;
  Gene Name: adaptor-related prt complex 2, beta 1 subunit;
  ENSP ID: ENSP00000481704
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLLGSDLGGGIGGSPA

SEQ ID NO: 2473 - protein, 937 aa, Homo sapiens
  Payload ID: 595;
  Gene Symbol: AP2B1;
  Gene Name: adaptor-related prt complex 2, beta 1 subunit;
  Uniprot ID:  P63010;
  ENSP ID: ENSP00000482315
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 2474 - protein, 677 aa, Homo sapiens; identical to SEQ ID NO: 2468
  Payload ID: 595;
  Gene Symbol: AP2B1;
  Gene Name: adaptor-related prt complex 2, beta 1 subunit;
  ENSP ID: ENSP00000482825

SEQ ID NO: 2475 - protein, 951 aa, Homo sapiens
  Payload ID: 595;
  Gene Symbol: AP2B1;
  Gene Name: adaptor-related prt complex 2, beta 1 subunit;
  Uniprot ID:  P63010;
  ENSP ID: ENSP00000482835
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLLGSDLGGGIGGSPAVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 2476 - protein, 951 aa, Homo sapiens; identical to SEQ ID NO: 2475
  Payload ID: 595;
  Gene Symbol: AP2B1;
  Gene Name: adaptor-related prt complex 2, beta 1 subunit;
  Uniprot ID:  P63010;
  ENSP ID: ENSP00000483185

SEQ ID NO: 2477 - protein, 913 aa, Homo sapiens
  Payload ID: 595;
  Gene Symbol: AP2B1;
  Gene Name: adaptor-related prt complex 2, beta 1 subunit;
  ENSP ID: ENSP00000484708
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLLGSDLGGGIGGSPAVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 2478 - protein, 63 aa, Homo sapiens; identical to SEQ ID NO: 2462
  Payload ID: 595;
  Gene Symbol: AP2B1;
  Gene Name: adaptor-related prt complex 2, beta 1 subunit;
  ENSP ID: ENSP00000487324

SEQ ID NO: 2479 - protein, 435 aa, Homo sapiens
  Payload ID: 596;
  Gene Symbol: AP2M1;
  Gene Name: adaptor-related prt complex 2, mu 1 subunit;
  Uniprot ID:  Q96CW1;
  ENSP ID: ENSP00000292807
MIGGLFIYNHKGEVLISRVYRDDIGRNAVDAFRVNVIHARQQVRSPVTNIARTSFFHVKRSNIWLAAVTKQNVNAAMVFEFLYKMCDVMAAYFGKISEENIKNNFVLIYELLDEILDFGYPQNSETGALKTFITQQGIKSQHQTKEEQSQITSQVTGQIGWRREGIKYRRNELFLDVLESVNLLMSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 2480 - protein, 433 aa, Homo sapiens
  Payload ID: 596;
  Gene Symbol: AP2M1;
  Gene Name: adaptor-related prt complex 2, mu 1 subunit;
  Uniprot ID:  Q96CW1;
  ENSP ID: ENSP00000371894
MIGGLFIYNHKGEVLISRVYRDDIGRNAVDAFRVNVIHARQQVRSPVTNIARTSFFHVKRSNIWLAAVTKQNVNAAMVFEFLYKMCDVMAAYFGKISEENIKNNFVLIYELLDEILDFGYPQNSETGALKTFITQQGIKSQTKEEQSQITSQVTGQIGWRREGIKYRRNELFLDVLESVNLLMSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 2481 - protein, 252 aa, Homo sapiens
  Payload ID: 596;
  Gene Symbol: AP2M1;
  Gene Name: adaptor-related prt complex 2, mu 1 subunit;
  ENSP ID: ENSP00000395438
MIGGLFIYNHKGEVLISRVYRDDIGRNAVDAFRVNVIHARQQVRSPVTNIARTSFFHVKRSNIWLAAVTKQNVNAAMVFEFLYKMCDVMAAYFGKISEENIKNNFVLIYELLDEILDFGYPQNSETGALKTFITQQGIKSQHQTKEEQSQITSQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVR

SEQ ID NO: 2482 - protein, 136 aa, Homo sapiens
  Payload ID: 596;
  Gene Symbol: AP2M1;
  Gene Name: adaptor-related prt complex 2, mu 1 subunit;
  ENSP ID: ENSP00000402051
MIGGLFIYNHKGEVLISRVYRDDIGSRQAADSAVFSSSGPFPGEWLEARNAVDAFRVNVIHARQQVRSPVTNIARTSFFHVKRSNIWLAAVTKQNVNAAMVFEFLYKMCDVMAAYFGKISEENIKNNFVLIYELLD

SEQ ID NO: 2483 - protein, 160 aa, Homo sapiens
  Payload ID: 596;
  Gene Symbol: AP2M1;
  Gene Name: adaptor-related prt complex 2, mu 1 subunit;
  ENSP ID: ENSP00000402592
MIGGLFIYNHKGEVLISRVYRDDIGNRRNAVDAFRVNVIHARQQVRSPVTNIARTSFFHVKRSNIWLAAVTKQNVNAAMVFEFLYKMCDVMAAYFGKISEENIKNNFVLIYELLDEILDFGYPQNSETGALKTFITQQGIKSQHQTKEEQSQITSQVTGQ

SEQ ID NO: 2484 - protein, 460 aa, Homo sapiens
  Payload ID: 596;
  Gene Symbol: AP2M1;
  Gene Name: adaptor-related prt complex 2, mu 1 subunit;
  ENSP ID: ENSP00000403362
MIGGLFIYNHKGEVLISRVYRDDIGSRQAADSAVFSSSGPFPGEWLEANRRNAVDAFRVNVIHARQQVRSPVTNIARTSFFHVKRSNIWLAAVTKQNVNAAMVFEFLYKMCDVMAAYFGKISEENIKNNFVLIYELLDEILDFGYPQNSETGALKTFITQQGIKSQHQTKEEQSQITSQVTGQIGWRREGIKYRRNELFLDVLESVNLLMSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 2485 - protein, 113 aa, Homo sapiens
  Payload ID: 596;
  Gene Symbol: AP2M1;
  Gene Name: adaptor-related prt complex 2, mu 1 subunit;
  ENSP ID: ENSP00000404031
MIGGLFIYNHKGEVLISRVYRDDIGRNAVDAFRVNVIHARQQVRSPVTNIARTSFFHVKRSNIWLAAVTKQNVNAAMVFEFLYKMCDVMAAYFGKISEENIKNNFVLIYELLD

SEQ ID NO: 2486 - protein, 195 aa, Homo sapiens
  Payload ID: 596;
  Gene Symbol: AP2M1;
  Gene Name: adaptor-related prt complex 2, mu 1 subunit;
  ENSP ID: ENSP00000404326
MIGGLFIYNHKGEVLISRVYRDDIGRNAVDAFRVNVIHARQQVRSPVTNIARTSFFHVKRSNIWLAAVTKQNVNAAMVFEFLYKMCDVMAAYFGKISEENIKNNFVLIYELLDEILDFGYPQNSETGALKTFITQQGIKSQHQVSSSLSFHPCSFALFLQALPFGAYRGKWITDKRRAVTDHQPGNWADWLAARG

SEQ ID NO: 2487 - protein, 433 aa, Homo sapiens; identical to SEQ ID NO: 2480
  Payload ID: 596;
  Gene Symbol: AP2M1;
  Gene Name: adaptor-related prt complex 2, mu 1 subunit;
  Uniprot ID:  Q96CW1;
  ENSP ID: ENSP00000409081

SEQ ID NO: 2488 - protein, 122 aa, Homo sapiens
  Payload ID: 596;
  Gene Symbol: AP2M1;
  Gene Name: adaptor-related prt complex 2, mu 1 subunit;
  ENSP ID: ENSP00000416688
FKPSLLAQKIEVRIPTPLNTSGVQVICMKGKAKYKASENAIVWKIKRMAGMKESQISAEIELLPTNDKKKWARPPISMNFEVWQRRGLESCQGMLEDLLEIIPINCCTLEVRKLRPRKKNWL

SEQ ID NO: 2489 - protein, 434 aa, Homo sapiens
  Payload ID: 596;
  Gene Symbol: AP2M1;
  Gene Name: adaptor-related prt complex 2, mu 1 subunit;
  ENSP ID: ENSP00000481563
MIGGLFIYNHKGEVLISRVYRDDIGRNAVDAFRVNVIHARQQVRSPVTNIARTSFFHVKRSNIWLAAVTKQNVNAAMVFEFLYKMCDVMAAYFGKISEENIKNNFVLIYELLDEILDFGYPQNSETGALKTFITQQGIKSQHTKEEQSQITSQVTGQIGWRREGIKYRRNELFLDVLESVNLLMSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 2490 - protein, 142 aa, Homo sapiens
  Payload ID: 597;
  Gene Symbol: AP2S1;
  Gene Name: adaptor-related prt complex 2, sigma 1 subunit;
  Uniprot ID:  P53680;
  ENSP ID: ENSP00000263270
MIRFILIQNRAGKTRLAKWYMQFDDDEKQKLIEEVHAVVTVRDAKHTNFVEFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 2491 - protein, 156 aa, Homo sapiens
  Payload ID: 597;
  Gene Symbol: AP2S1;
  Gene Name: adaptor-related prt complex 2, sigma 1 subunit;
  ENSP ID: ENSP00000263271
MIRFILIQNRAGKTRLAKWYMQFDDDEKQKLIEEVHAVVTVRDAKHTNFVEVLAISVADSLSVLQFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 2492 - protein, 158 aa, Homo sapiens
  Payload ID: 597;
  Gene Symbol: AP2S1;
  Gene Name: adaptor-related prt complex 2, sigma 1 subunit;
  ENSP ID: ENSP00000470176
MKLKGLGKRCKRREDLEIRFILIQNRAGKTRLAKWYMQFDDDEKQKLIEEVHAVVTVRDAKHTNFVEFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 2493 - protein, 122 aa, Homo sapiens
  Payload ID: 597;
  Gene Symbol: AP2S1;
  Gene Name: adaptor-related prt complex 2, sigma 1 subunit;
  ENSP ID: ENSP00000470235
MQFDDDEKQKLIEEVHAVVTVRDAKHTNFVEFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 2494 - protein, 104 aa, Homo sapiens
  Payload ID: 597;
  Gene Symbol: AP2S1;
  Gene Name: adaptor-related prt complex 2, sigma 1 subunit;
  Uniprot ID:  P53680;
  ENSP ID: ENSP00000470898
MIRFILIQNRAGKTRLAKWYMQFDDDEKQKLIEEVHAVVTVRDAKHTNFVEVLNEYFHNVCELDLVFNFYKVYTVVDEMFLAGEIRETSQTKVLKQLLMLQSLE

SEQ ID NO: 2495 - protein, 144 aa, Homo sapiens
  Payload ID: 597;
  Gene Symbol: AP2S1;
  Gene Name: adaptor-related prt complex 2, sigma 1 subunit;
  ENSP ID: ENSP00000471340
MVWIRFILIQNRAGKTRLAKWYMQFDDDEKQKLIEEVHAVVTVRDAKHTNFVEFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 2496 - protein, 92 aa, Homo sapiens
  Payload ID: 597;
  Gene Symbol: AP2S1;
  Gene Name: adaptor-related prt complex 2, sigma 1 subunit;
  ENSP ID: ENSP00000472080
MFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 2497 - protein, 1094 aa, Homo sapiens
  Payload ID: 598;
  Gene Symbol: AP3B1;
  Gene Name: adaptor-related prt complex 3, beta 1 subunit;
  Uniprot ID:  O00203;
  ENSP ID: ENSP00000255194
MSSNSFPYNEQSGGGEATELGQEATSTISPSGAFGLFSSDLKKNEDLKQMLESNKDSAKLDAMKRIVGMIAKGKNASELFPAVVKNVASKNIEIKKLVYVYLVRYAEEQQDLALLSISTFQRALKDPNQLIRASALRVLSSIRVPIIVPIMMLAIKEASADLSPYVRKNAAHAIQKLYSLDPEQKEMLIEVIEKLLKDKSTLVAGSVVMAFEEVCPDRIDLIHKNYRKLCNLLVDVEEWGQVVIIHMLTRYARTQFVSPWKEGDELEDNGKNFYESDDDQKEKTDKKKKPYTMDPDHRLLIRNTKPLLQSRNAAVVMAVAQLYWHISPKSEAGIISKSLVRLLRSNREVQYIVLQNIATMSIQRKGMFEPYLKSFYVRSTDPTMIKTLKLEILTNLANEANISTLLREFQTYVKSQDKQFAAATIQTIGRCATNILEVTDTCLNGLVCLLSNRDEIVVAESVVVIKKLLQMQPAQHGEIIKHMAKLLDSITVPVARASILWLIGENCERVPKIAPDVLRKMAKSFTSEDDLVKLQILNLGAKLYLTNSKQTKLLTQYILNLGKYDQNYDIRDRTRFIRQLIVPNVKSGALSKYAKKIFLAQKPAPLLESPFKDRDHFQLGTLSHTLNIKATGYLELSNWPEVAPDPSVRNVEVIELAKEWTPAGKAKQENSAKKFYSESEEEEDSSDSSSDSESESGSESGEQGESGEEGDSNEDSSEDSSSEQDSESGRESGLENKRTAKRNSKAKGKSDSEDGEKENEKSKTSDSSNDESSSIEDSSSDSESESEPESESESRRVTKEKEKKTKQDRTPLTKDVSLLDLDDFNPVSTPVALPTPALSPSLMADLEGLHLSTSSSVISVSTPAFVPTKTHVLLHRMSGKGLAAHYFFPRQPCIFGDKMVSIQITLNNTTDRKIENIHIGEKKLPIGMKMHVFNPIDSLEPEGSITVSMGIDFCDSTQTASFQLCTKDDCFNVNIQPPVGELLLPVAMSEKDFKKEQGVLTGMNETSAVIIAAPQNFTPSVIFQKVVNVANVGAVPSGQDNIHRFAAKTVHSGSLMLVTVELKEGSTAQLIINTEKTVIGSVLLRELKPVLSQG

SEQ ID NO: 2498 - protein, 154 aa, Homo sapiens
  Payload ID: 598;
  Gene Symbol: AP3B1;
  Gene Name: adaptor-related prt complex 3, beta 1 subunit;
  ENSP ID: ENSP00000429228
  MOD_RES (1)..(1): Any amino acid
XIQITLNNTTDRKIENIHIGEKKLPIGMKMHVFNPIDSLEPEGSITVSMGIDFCDSTQTASFQLCTKDDCFNVNIQPPVGELLLPVAMSEKDFKKEQGVLTGMNETSAVIIAAPQNFTPSVIFQKVVNVANVGAVPSGQDNIHRSLFFLFQVCS

SEQ ID NO: 2499 - protein, 1045 aa, Homo sapiens
  Payload ID: 598;
  Gene Symbol: AP3B1;
  Gene Name: adaptor-related prt complex 3, beta 1 subunit;
  Uniprot ID:  O00203;
  ENSP ID: ENSP00000430597
MLESNKDSAKLDAMKRIVGMIAKGKNASELFPAVVKNVASKNIEIKKLVYVYLVRYAEEQQDLALLSISTFQRALKDPNQLIRASALRVLSSIRVPIIVPIMMLAIKEASADLSPYVRKNAAHAIQKLYSLDPEQKEMLIEVIEKLLKDKSTLVAGSVVMAFEEVCPDRIDLIHKNYRKLCNLLVDVEEWGQVVIIHMLTRYARTQFVSPWKEGDELEDNGKNFYESDDDQKEKTDKKKKPYTMDPDHRLLIRNTKPLLQSRNAAVVMAVAQLYWHISPKSEAGIISKSLVRLLRSNREVQYIVLQNIATMSIQRKGMFEPYLKSFYVRSTDPTMIKTLKLEILTNLANEANISTLLREFQTYVKSQDKQFAAATIQTIGRCATNILEVTDTCLNGLVCLLSNRDEIVVAESVVVIKKLLQMQPAQHGEIIKHMAKLLDSITVPVARASILWLIGENCERVPKIAPDVLRKMAKSFTSEDDLVKLQILNLGAKLYLTNSKQTKLLTQYILNLGKYDQNYDIRDRTRFIRQLIVPNVKSGALSKYAKKIFLAQKPAPLLESPFKDRDHFQLGTLSHTLNIKATGYLELSNWPEVAPDPSVRNVEVIELAKEWTPAGKAKQENSAKKFYSESEEEEDSSDSSSDSESESGSESGEQGESGEEGDSNEDSSEDSSSEQDSESGRESGLENKRTAKRNSKAKGKSDSEDGEKENEKSKTSDSSNDESSSIEDSSSDSESESEPESESESRRVTKEKEKKTKQDRTPLTKDVSLLDLDDFNPVSTPVALPTPALSPSLMADLEGLHLSTSSSVISVSTPAFVPTKTHVLLHRMSGKGLAAHYFFPRQPCIFGDKMVSIQITLNNTTDRKIENIHIGEKKLPIGMKMHVFNPIDSLEPEGSITVSMGIDFCDSTQTASFQLCTKDDCFNVNIQPPVGELLLPVAMSEKDFKKEQGVLTGMNETSAVIIAAPQNFTPSVIFQKVVNVANVGAVPSGQDNIHRFAAKTVHSGSLMLVTVELKEGSTAQLIINTEKTVIGSVLLRELKPVLSQG

SEQ ID NO: 2500 - protein, 1082 aa, Homo sapiens
  Payload ID: 599;
  Gene Symbol: AP3B2;
  Gene Name: adaptor-related prt complex 3, beta 2 subunit;
  Uniprot ID:  Q13367;
  ENSP ID: ENSP00000261722
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDFTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 2501 - protein, 1050 aa, Homo sapiens
  Payload ID: 599;
  Gene Symbol: AP3B2;
  Gene Name: adaptor-related prt complex 3, beta 2 subunit;
  Uniprot ID:  Q13367;
  ENSP ID: ENSP00000438721
MSAAPAYSEDKGGSAGPGEPEYGHDPASGGIFSSDYKRHDDLKEMLDTNKDSLKLEAMKRIVAMIARGKNASDLFPAVVKNVACKNIEDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDFTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 2502 - protein, 141 aa, Homo sapiens
  Payload ID: 599;
  Gene Symbol: AP3B2;
  Gene Name: adaptor-related prt complex 3, beta 2 subunit;
  ENSP ID: ENSP00000440719
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKEPVVMAASSMNHLSPRRVESL

SEQ ID NO: 2503 - protein, 1101 aa, Homo sapiens
  Payload ID: 599;
  Gene Symbol: AP3B2;
  Gene Name: adaptor-related prt complex 3, beta 2 subunit;
  Uniprot ID:  Q13367;
  ENSP ID: ENSP00000440984
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEEEDLSLIETHVGLLGEYTEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDFTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 2504 - protein, 193 aa, Homo sapiens
  Payload ID: 599;
  Gene Symbol: AP3B2;
  Gene Name: adaptor-related prt complex 3, beta 2 subunit;
  ENSP ID: ENSP00000441961
MLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQV

SEQ ID NO: 2505 - protein, 22 aa, Homo sapiens
  Payload ID: 599;
  Gene Symbol: AP3B2;
  Gene Name: adaptor-related prt complex 3, beta 2 subunit;
  ENSP ID: ENSP00000445804
ISLLDLEDCSLLNPSHLHFASS

SEQ ID NO: 2506 - protein, 1082 aa, Homo sapiens; identical to SEQ ID NO: 2500
  Payload ID: 599;
  Gene Symbol: AP3B2;
  Gene Name: adaptor-related prt complex 3, beta 2 subunit;
  Uniprot ID:  Q13367;
  ENSP ID: ENSP00000479229

SEQ ID NO: 2507 - protein, 1153 aa, Homo sapiens
  Payload ID: 600;
  Gene Symbol: AP3D1;
  Gene Name: adaptor-related prt complex 3, delta 1 subunit;
  Uniprot ID:  O14617;
  ENSP ID: ENSP00000344055
MALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 2508 - protein, 1215 aa, Homo sapiens
  Payload ID: 600;
  Gene Symbol: AP3D1;
  Gene Name: adaptor-related prt complex 3, delta 1 subunit;
  Uniprot ID:  O14617;
  ENSP ID: ENSP00000347416
MALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTGELSVNTVTTPKDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 2509 - protein, 193 aa, Homo sapiens
  Payload ID: 600;
  Gene Symbol: AP3D1;
  Gene Name: adaptor-related prt complex 3, delta 1 subunit;
  ENSP ID: ENSP00000466267
  MOD_RES (1)..(1): Any amino acid
XELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSGLLKLWPRAAQEGGPCSGGGAAAMQCPGSLTLPALLQLWSEWTPAPPCTAAPSRATMSASW

SEQ ID NO: 2510 - protein, 155 aa, Homo sapiens
  Payload ID: 600;
  Gene Symbol: AP3D1;
  Gene Name: adaptor-related prt complex 3, delta 1 subunit;
  ENSP ID: ENSP00000468449
  MOD_RES (1)..(1): Any amino acid
XGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYRIFWRRSVFTTIFPLWSEWTPAPPCTAAPSRATMSASW

SEQ ID NO: 2511 - protein, 203 aa, Homo sapiens
  Payload ID: 600;
  Gene Symbol: AP3D1;
  Gene Name: adaptor-related prt complex 3, delta 1 subunit;
  ENSP ID: ENSP00000481961
  MOD_RES (1)..(1): Any amino acid
XLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSAHLAVLRHAQPQRQHPALCSEIKDIDRGLRSELEVPGAAGNVQDPEDPPQVRAVPQGPHPAVPGRQGRVHPAAGPGPALWDGVQEEPDGDREEADDPRRQGRGYHLP

SEQ ID NO: 2512 - protein, 418 aa, Homo sapiens
  Payload ID: 601;
  Gene Symbol: AP3M1;
  Gene Name: adaptor-related prt complex 3, mu 1 subunit;
  Uniprot ID:  Q9Y2T2;
  ENSP ID: ENSP00000347408
MIHSLFLINCSGDIFLEKHWKSVVSQSVCDYFFEAQEKAADVENVPPVISTPHHYLISIYRDKLFFVSVIQTEVPPLFVIEFLHRVADTFQDYFGECSEAAIKDNVVIVYELLEEMLDNGFPLATESNILKELIKPPTILRSVVNSITGSSNVGDTLPTGQLSNIPWRRAGVKYTNNEAYFDVVEEIDAIIDKSGSTVFAEIQGVIDACIKLSGMPDLSLSFMNPRLLDDVSFHPCIRFKRWESERVLSFIPPDGNFRLISYRVSSQNLVAIPVYVKHSISFKENSSCGRFDITIGPKQNMGKTIEGITVTVHMPKVVLNMNLTPTQGSYTFDPVTKVLTWDVGKITPQKLPSLKGLVNLQSGAPKPEENPSLNIQFKIQQLAISGLKVNRLDMYGEKYKPFKGVKYVTKAGKFQVRT

SEQ ID NO: 2513 - protein, 418 aa, Homo sapiens; identical to SEQ ID NO: 2512
  Payload ID: 601;
  Gene Symbol: AP3M1;
  Gene Name: adaptor-related prt complex 3, mu 1 subunit;
  Uniprot ID:  Q9Y2T2;
  ENSP ID: ENSP00000361831

SEQ ID NO: 2514 - protein, 418 aa, Homo sapiens
  Payload ID: 602;
  Gene Symbol: AP3M2;
  Gene Name: adaptor-related prt complex 3, mu 2 subunit;
  Uniprot ID:  P53677;
  ENSP ID: ENSP00000174653
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTGMPDLTLSFMNPRLLDDVSFHPCVRFKRWESERILSFIPPDGNFRLLSYHVSAQNLVAIPVYVKHNISFRDSSSLGRFEITVGPKQTMGKTIEGVTVTSQMPKGVLNMSLTPSQGTHTFDPVTKMLSWDVGKINPQKLPSLKGTMSLQAGASKPDENPTINLQFKIQQLAISGLKVNRLDMYGEKYKPFKGIKYMTKAGKFQVRT

SEQ ID NO: 2515 - protein, 418 aa, Homo sapiens; identical to SEQ ID NO: 2514
  Payload ID: 602;
  Gene Symbol: AP3M2;
  Gene Name: adaptor-related prt complex 3, mu 2 subunit;
  Uniprot ID:  P53677;
  ENSP ID: ENSP00000380132

SEQ ID NO: 2516 - protein, 97 aa, Homo sapiens
  Payload ID: 602;
  Gene Symbol: AP3M2;
  Gene Name: adaptor-related prt complex 3, mu 2 subunit;
  ENSP ID: ENSP00000428279
  MOD_RES (1)..(1): Any amino acid
XTSQMPKGVLNMSLTPSQGTHTFDPVTKMLSWDVGKINPQKLPSLKGTMSLQAGASKPDENPTINLQFKIQQLAISEDFHVCSYFYFGTTGPFQDSR

SEQ ID NO: 2517 - protein, 418 aa, Homo sapiens; identical to SEQ ID NO: 2514
  Payload ID: 602;
  Gene Symbol: AP3M2;
  Gene Name: adaptor-related prt complex 3, mu 2 subunit;
  Uniprot ID:  P53677;
  ENSP ID: ENSP00000428787

SEQ ID NO: 2518 - protein, 131 aa, Homo sapiens
  Payload ID: 602;
  Gene Symbol: AP3M2;
  Gene Name: adaptor-related prt complex 3, mu 2 subunit;
  ENSP ID: ENSP00000429037
DYFGVCSEPVIKDNVVVVYEVLEEMLDNGFPLATESNILKELIKPPTILRTVVNTITGSTITAEIQGVIDACVKLTGMPDLTLSFMNPRLLDDVSFHPCVRFKRWESERILSFIPPDGNFRLLSYHVSAQK

SEQ ID NO: 2519 - protein, 268 aa, Homo sapiens
  Payload ID: 602;
  Gene Symbol: AP3M2;
  Gene Name: adaptor-related prt complex 3, mu 2 subunit;
  ENSP ID: ENSP00000429435
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTGMPDLTLSFMNPRLLDDVSFHPCVRFKRWESERILSFIPPDGNFRLLSYHVSAQK

SEQ ID NO: 2520 - protein, 139 aa, Homo sapiens
  Payload ID: 602;
  Gene Symbol: AP3M2;
  Gene Name: adaptor-related prt complex 3, mu 2 subunit;
  ENSP ID: ENSP00000429515
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTI

SEQ ID NO: 2521 - protein, 48 aa, Homo sapiens
  Payload ID: 602;
  Gene Symbol: AP3M2;
  Gene Name: adaptor-related prt complex 3, mu 2 subunit;
  ENSP ID: ENSP00000429804
PTINLQFKIQQLAISGLKVNRLDMYGEKYKPFKGIKYMTKAGKFQVRT

SEQ ID NO: 2522 - protein, 109 aa, Homo sapiens
  Payload ID: 602;
  Gene Symbol: AP3M2;
  Gene Name: adaptor-related prt complex 3, mu 2 subunit;
  ENSP ID: ENSP00000430200
MIHSLFLINSSGDIFLEKHWKSVVSRSVCDYFFEAQERATEAENVPPVIPTPHHYLLSVYRHKIFFVAVIQTEVPPLFVIEFLHRVVDTFQYYCSGISVLMQHTGPFAQ

SEQ ID NO: 2523 - protein, 10 aa, Homo sapiens
  Payload ID: 602;
  Gene Symbol: AP3M2;
  Gene Name: adaptor-related prt complex 3, mu 2 subunit;
  ENSP ID: ENSP00000430538
MIHSLFLINS

SEQ ID NO: 2524 - protein, 287 aa, Homo sapiens
  Payload ID: 602;
  Gene Symbol: AP3M2;
  Gene Name: adaptor-related prt complex 3, mu 2 subunit;
  ENSP ID: ENSP00000430616
MLDNGFPLATESNILKELIKPPTILRTVVNTITGSTNVGDQLPTGQLSVVPWRRTGVKYTNNEAYFDVIEEIDAIIDKSGSTITAEIQGVIDACVKLTGMPDLTLSFMNPRLLDDVSFHPCVRFKRWESERILSFIPPDGNFRLLSYHVSAQNLVAIPVYVKHNISFRDSSSLGRFEITVGPKQTMGKTIEGVTVTSQMPKGVLNMSLTPSQGTHTFDPVTKMLSWDVGKINPQKLPSLKGTMSLQAGASKPDENPTINLQFKIQQLAISGLKVNRLDMYGEKYKPF

SEQ ID NO: 2525 - protein, 273 aa, Homo sapiens
  Payload ID: 602;
  Gene Symbol: AP3M2;
  Gene Name: adaptor-related prt complex 3, mu 2 subunit;
  Uniprot ID:  P53677;
  ENSP ID: ENSP00000431918
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTGMPDLTLSFMNPRLLDDVSFHPCVRFKRWESERILSFIPPDGNFRLLSYHVSAQKCCLGM

SEQ ID NO: 2526 - protein, 193 aa, Homo sapiens
  Payload ID: 603;
  Gene Symbol: AP3S1;
  Gene Name: adaptor-related prt complex 3, sigma 1 subunit;
  Uniprot ID:  Q92572;
  ENSP ID: ENSP00000325369
MIKAILIFNNHGKPRLSKFYQPYSEDTQQQIIRETFHLVSKRDENVCNFLEGGLLIGGSDNKLIYRHYATLYFVFCVDSSESELGILDLIQVFVETLDKCFENVCELDLIFHVDKVHNILAEMVMGGMVLETNMNEIVTQIDAQNKLEKSEAGLAGAPARAVSAVKNMNLPEIPRNINIGDISIKVPNLPSFK

SEQ ID NO: 2527 - protein, 162 aa, Homo sapiens
  Payload ID: 603;
  Gene Symbol: AP3S1;
  Gene Name: adaptor-related prt complex 3, sigma 1 subunit;
  ENSP ID: ENSP00000446179
MIKAILIFNNHGKPRLSKFYQPYSEDTQQQIIRETFHLVSKRDENVCNFLEGGLLIGGSDNKLIYRHYATLYFVFCVDSSESELGILDLIQVFVETLDKCFENVCELDLIFHVDKVHNILAEMVMGGMVLETNMNEIVTQIDAQNKLEKSETFIFQSPRQDR

SEQ ID NO: 2528 - protein, 193 aa, Homo sapiens
  Payload ID: 604;
  Gene Symbol: AP3S2;
  Gene Name: adaptor-related prt complex 3, sigma 2 subunit;
  Uniprot ID:  P59780;
  ENSP ID: ENSP00000338777
MIQAILVFNNHGKPRLVRFYQRFPEEIQQQIVRETFHLVLKRDDNICNFLEGGSLIGGSDYKLIYRHYATLYFVFCVDSSESELGILDLIQVFVETLDKCFENVCELDLIFHMDKVHYILQEVVMGGMVLETNMNEIVAQIEAQNRLEKSEGGLSAAPARAVSAVKNINLPEIPRNINIGDLNIKVPNLSQFV

SEQ ID NO: 2529 - protein, 124 aa, Homo sapiens
  Payload ID: 604;
  Gene Symbol: AP3S2;
  Gene Name: adaptor-related prt complex 3, sigma 2 subunit;
  Uniprot ID:  P59780;
  ENSP ID: ENSP00000394170
MIQAILVFNNHGKPRLVRFYQRFPEEIQQQIVRETFHLVLKRDDNICNFLEGGSLIGGSDYKLIYRHYATLYFVFCVDSSESELGILDLIQLKKRERKKSQCNTLQTGTLALWEQGPDIRTRRL

SEQ ID NO: 2530 - protein, 44 aa, Homo sapiens
  Payload ID: 604;
  Gene Symbol: AP3S2;
  Gene Name: adaptor-related prt complex 3, sigma 2 subunit;
  ENSP ID: ENSP00000452862
MIQAILVFNNHGKPRLVRFYQRFVTRRNSTADCSRDFPSSPQAG

SEQ ID NO: 2531 - protein, 205 aa, Homo sapiens
  Payload ID: 604;
  Gene Symbol: AP3S2;
  Gene Name: adaptor-related prt complex 3, sigma 2 subunit;
  ENSP ID: ENSP00000453223
MIQAILVFNNHGKPRLVRFYQRFPEEIQQQIVRETFHLVLKRDDNICNFLEGGSLIGGSDYKLIYRHYATLYFVFCVDSSESELGILDLIQVHLEVVFFIAPKVFVETLDKCFENVCELDLIFHMDKVHYILQEVVMGGMVLETNMNEIVAQIEAQNRLEKSEGGLSAAPARAVSAVKNINLPEIPRNINIGDLNIKVPNLSQFV

SEQ ID NO: 2532 - protein, 124 aa, Homo sapiens; identical to SEQ ID NO: 2529
  Payload ID: 604;
  Gene Symbol: AP3S2;
  Gene Name: adaptor-related prt complex 3, sigma 2 subunit;
  Uniprot ID:  P59780;
  ENSP ID: ENSP00000453288

SEQ ID NO: 2533 - protein, 136 aa, Homo sapiens
  Payload ID: 604;
  Gene Symbol: AP3S2;
  Gene Name: adaptor-related prt complex 3, sigma 2 subunit;
  ENSP ID: ENSP00000453380
MIQAILVFNNHGKPRLVRFYQRFPEEIQQQIVRETFHLVLKRDDNICNFLEGGSLIGGSDYKLIYRHYATLYFVFCVDSSESELGILDLIQVHLEVVFFIAPKLKKRERKKSQCNTLQTGTLALWEQGPDIRTRRL

SEQ ID NO: 2534 - protein, 156 aa, Homo sapiens
  Payload ID: 604;
  Gene Symbol: AP3S2;
  Gene Name: adaptor-related prt complex 3, sigma 2 subunit;
  ENSP ID: ENSP00000453852
MIQAILVFNNHGKPRLVRFYQRFPEEIQQQIVRETFHLVLKRDDNICNFLEGGSLIGGSDYKLIYRHYATLYFVFCVDSSESELGILDLIQVFVETLDKCFENVCELDLIFHMDKVHYILQEVVMGGMVLETNMNEIVAQIEAQNRLEKSEDQVLA

SEQ ID NO: 2535 - protein, 36 aa, Homo sapiens
  Payload ID: 604;
  Gene Symbol: AP3S2;
  Gene Name: adaptor-related prt complex 3, sigma 2 subunit;
  ENSP ID: ENSP00000454027
MIQAILVFNNHGKPRLVRFYQRFKKFNSRLFERLSI

SEQ ID NO: 2536 - protein, 63 aa, Homo sapiens
  Payload ID: 604;
  Gene Symbol: AP3S2;
  Gene Name: adaptor-related prt complex 3, sigma 2 subunit;
  ENSP ID: ENSP00000481434
MIQAILVFNNHGKPRLVRFYQRFVSAARLHHAPSGRPLCLPSSLASRRPGAPLFGHLGLLHRA

SEQ ID NO: 2537 - protein, 739 aa, Homo sapiens
  Payload ID: 605;
  Gene Symbol: AP4B1;
  Gene Name: adaptor-related prt complex 4, beta 1 subunit;
  Uniprot ID:  Q9Y6B7;
  ENSP ID: ENSP00000256658
MPYLGSEDVVKELKKALCNPHIQADRLRYRNVIQRVIRYMTQGLDMSGVFMEMVKASATVDIVQKKLVYLYMCTYAPLKPDLALLAINTLCKDCSDPNPMVRGLALRSMCSLRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAIGGIARTYTDQCVQILTELLGLRQEHITTVVVQTFRDLVWLCPQCTEAVCQALPGCEENIQDSEGKQALIWLLGVHGERIPNAPYVLEDFVENVKSETFPAVKMELLTALLRLFLSRPAECQDMLGRLLYYCIEEEKDMAVRDRGLFYYRLLLVGIDEVKRILCSPKSDPTLGLLEDPAERPVNSWASDFNTLVPVYGKAHWATISKCQGAERCDPELPKTSSFAASGPLIPEENKERVQELPDSGALMLVPNRQLTADYFEKTWLSLKVAHQQVLPWRGEFHPDTLQMALQVVNIQTIAMSRAGSRPWKAYLSAQDDTGCLFLTELLLEPGNSEMQISVKQNEARTETLNSFISVLETVIGTIEEIKS

SEQ ID NO: 2538 - protein, 296 aa, Homo sapiens
  Payload ID: 605;
  Gene Symbol: AP4B1;
  Gene Name: adaptor-related prt complex 4, beta 1 subunit;
  ENSP ID: ENSP00000358577
MPYLGSEDVVKELKKALCNPHIQADRLRYRNVIQRVIRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAI

SEQ ID NO: 2539 - protein, 571 aa, Homo sapiens
  Payload ID: 605;
  Gene Symbol: AP4B1;
  Gene Name: adaptor-related prt complex 4, beta 1 subunit;
  ENSP ID: ENSP00000358580
MPYLGSEDVVKELKKALCNPHIQADRLRYRNVIQRVIRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAIGGIARTYTDQCVQILTELLGLRQEHITTVVVQTFRDLVWLCPQCTEAVCQALPGCEENIQDSEGKQALIWLLGVHGERIPNAPYVLEDFVENVKSETFPAVKMELLTALLRLFLSRPAECQDMLGRLLYYCIEEEKDMAVRDRGLFYYRLLLVGIDEVKRILCSPKSDPTLGLLEDPAERPVNSWASDFNTLVPVYGKAHWATISKCQGAERCDPELPKTSSFAASGPLIPEENKERVQELPDSGALMLVPNRQLTADYFEKTWLSLKVAHQQVLPWRGEFHPDTLQMALQVVNIQTIAMSRAGSRPWKAYLSAQDDTGCLFLTELLLEPGNSEMQISVKQNEARTETLNSFISVLETVIGTIEEIKS

SEQ ID NO: 2540 - protein, 739 aa, Homo sapiens; identical to SEQ ID NO: 2537
  Payload ID: 605;
  Gene Symbol: AP4B1;
  Gene Name: adaptor-related prt complex 4, beta 1 subunit;
  Uniprot ID:  Q9Y6B7;
  ENSP ID: ENSP00000358582

SEQ ID NO: 2541 - protein, 262 aa, Homo sapiens
  Payload ID: 605;
  Gene Symbol: AP4B1;
  Gene Name: adaptor-related prt complex 4, beta 1 subunit;
  ENSP ID: ENSP00000358584
MPYLGSEDVVKELKKALCNPHIQADRLRYRNVIQRVIRYMTQGLDMSGVFMEMVKASATVDIVQKKLVYLYMCTYAPLKPDLALLAINTLCKDCSDPNPMVRGLALRSMCSLRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLIL

SEQ ID NO: 2542 - protein, 175 aa, Homo sapiens
  Payload ID: 605;
  Gene Symbol: AP4B1;
  Gene Name: adaptor-related prt complex 4, beta 1 subunit;
  ENSP ID: ENSP00000393622
MPYLGSEDVVKELKKALCNPHIQADRLRYRNVIQRVIRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDE

SEQ ID NO: 2543 - protein, 1137 aa, Homo sapiens
  Payload ID: 606;
  Gene Symbol: AP4E1;
  Gene Name: adaptor-related prt complex 4, epsilon 1 subunit;
  Uniprot ID:  Q9UPM8;
  ENSP ID: ENSP00000261842
MSDIVEKTLTALPGLFLQNQPGGGPAAAKASFSSRLGSLVRGITALTSKHEEEKLIQQELSSLKATVSAPTTTLKMMKECMVRLIYCEMLGYDASFGYIHAIKLAQQGNLLEKRVGYLAVSLFLHESHELLLLLVNTVVKDLQSTNLVEVCMALTVVSQIFPCEMIPAVLPLIEDKLQHSKEIVRRKAVLALYKFHLIAPNQVQHIHIKFRKALCDRDVGVMAASLHIYLRMIKENSSGYKDLTGSFVTILKQVVGGKLPVEFNYHSVPAPWLQIQLLRILGLLGKDDQRTSELMYDVLDESLRRAELNHNVTYAILFECVHTVYSIYPKSELLEKAAKCIGKFVLSPKINLKYLGLKALTYVIQQDPTLALQHQMTIIECLDHPDPIIKRETLELLYRITNAQNITVIVQKMLEYLHQSKEEYVIVNLVGKIAELAEKYAPDNAWFIQTMNAVFSVGGDVMHPDIPNNFLRLLAEGFDDETEDQQLRLYAVQSYLTLLDMENVFYPQRFLQVMSWVLGEYSYLLDKETPEEVIAKLYKLLMNDSVSSETKAWLIAAVTKLTSQAHSSNTVERLIHEFTISLDTCMRQHAFELKHLHENVELMKSLLPVDRSCEDLVVDASLSFLDGFVAEGLSQGAAPYKPPHQRQEEKLSQEKVLNFEPYGLSFSSSGFTGRQSPAGISLGSDVSGNSAETGLKETNSLKLEGIKKLWGKEGYLPKKESKTGDESGALPVPQESIMENVDQAITKKDQSQVLTQSKEEKEKQLLASSLFVGLGSESTINLLGKADTVSHKFRRKSKVKEAKSGETTSTHNMTCSSFSSLSNVAYEDDYYSNTLHDTGDKELKKFSLTSELLDSESLTELPLVEKFSYCSLSTPSLFANNNMEIFHPPQSTAASVAKESSLASSFLEETTEYIHSNAMEVCNNETISVSSYKIWKDDCLLMVWSVTNKSGLELKSADLEIFPAENFKVTEQPGCCLPVMEAESTKSFQYSVQIEKPFTEGNLTGFISYHMMDTHSAQLEFSVNLSLLDFIRPLKISSDDFGKLWLSFANDVKQNVKMSESQAALPSALKTLQQKLRLHIIEIIGNEGLLACQLLPSIPCLLHCRVHADVLALWFRSSCSTLPDYLLYQCQKVMEGS

SEQ ID NO: 2544 - protein, 218 aa, Homo sapiens
  Payload ID: 606;
  Gene Symbol: AP4E1;
  Gene Name: adaptor-related prt complex 4, epsilon 1 subunit;
  ENSP ID: ENSP00000452711
MMKECMVRLIYCEMLGYDASFGYIHAIKLAQQGNLLEKRVGYLAVSLFLHESHELLLLLVNTVVKDLQSTNLVEVCMALTVVSQIFPCEMIPAVLPLIEDKLQHSKEIVRRKAVLALYKFHLIAPNQVQHIHIKFRKALCDRDVGVMAASLHIYLRMIKENSSGYKDLTGSFVTILKQVVGGKLPVEFNYHSVPAPWLQIQLLRILGLLGKDDQSYFV

SEQ ID NO: 2545 - protein, 321 aa, Homo sapiens
  Payload ID: 606;
  Gene Symbol: AP4E1;
  Gene Name: adaptor-related prt complex 4, epsilon 1 subunit;
  ENSP ID: ENSP00000452712
MSDIVEKTLTALPGLFLQNQPGGGPAAAKASFSSRLGSLVRGITALTSKHEEEKLIQQELSSLKATVSAPTTTLKMMKECMVRLIYCEMLGYDASFGYIHAIKLAQQGNLLEKRVGYLAVSLFLHESHELLLLLVNTVVKDLQSTNLVEVCMALTVVSQIFPCEMIPAVLPLIEDKLQHSKEIVRRKAVLALYKFHLIAPNQVQHIHIKFRKALCDRDVGVMAASLHIYLRMIKENSSGYKDLTGSFVTILKQVVGGKLPVEFNYHSVPAPWLQIQLLRILGLLGKDDQRSSVLKRSLKNCFIGLEYYNSTANKISFKQDK

SEQ ID NO: 2546 - protein, 1062 aa, Homo sapiens
  Payload ID: 606;
  Gene Symbol: AP4E1;
  Gene Name: adaptor-related prt complex 4, epsilon 1 subunit;
  Uniprot ID:  Q9UPM8;
  ENSP ID: ENSP00000452976
MMKECMVRLIYCEMLGYDASFGYIHAIKLAQQGNLLEKRVGYLAVSLFLHESHELLLLLVNTVVKDLQSTNLVEVCMALTVVSQIFPCEMIPAVLPLIEDKLQHSKEIVRRKAVLALYKFHLIAPNQVQHIHIKFRKALCDRDVGVMAASLHIYLRMIKENSSGYKDLTGSFVTILKQVVGGKLPVEFNYHSVPAPWLQIQLLRILGLLGKDDQRTSELMYDVLDESLRRAELNHNVTYAILFECVHTVYSIYPKSELLEKAAKCIGKFVLSPKINLKYLGLKALTYVIQQDPTLALQHQMTIIECLDHPDPIIKRETLELLYRITNAQNITVIVQKMLEYLHQSKEEYVIVNLVGKIAELAEKYAPDNAWFIQTMNAVFSVGGDVMHPDIPNNFLRLLAEGFDDETEDQQLRLYAVQSYLTLLDMENVFYPQRFLQVMSWVLGEYSYLLDKETPEEVIAKLYKLLMNDSVSSETKAWLIAAVTKLTSQAHSSNTVERLIHEFTISLDTCMRQHAFELKHLHENVELMKSLLPVDRSCEDLVVDASLSFLDGFVAEGLSQGAAPYKPPHQRQEEKLSQEKVLNFEPYGLSFSSSGFTGRQSPAGISLGSDVSGNSAETGLKETNSLKLEGIKKLWGKEGYLPKKESKTGDESGALPVPQESIMENVDQAITKKDQSQVLTQSKEEKEKQLLASSLFVGLGSESTINLLGKADTVSHKFRRKSKVKEAKSGETTSTHNMTCSSFSSLSNVAYEDDYYSNTLHDTGDKELKKFSLTSELLDSESLTELPLVEKFSYCSLSTPSLFANNNMEIFHPPQSTAASVAKESSLASSFLEETTEYIHSNAMEVCNNETISVSSYKIWKDDCLLMVWSVTNKSGLELKSADLEIFPAENFKVTEQPGCCLPVMEAESTKSFQYSVQIEKPFTEGNLTGFISYHMMDTHSAQLEFSVNLSLLDFIRPLKISSDDFGKLWLSFANDVKQNVKMSESQAALPSALKTLQQKLRLHIIEIIGNEGLLACQLLPSIPCLLHCRVHADVLALWFRSSCSTLPDYLLYQCQKVMEGS

SEQ ID NO: 2547 - protein, 368 aa, Homo sapiens
  Payload ID: 606;
  Gene Symbol: AP4E1;
  Gene Name: adaptor-related prt complex 4, epsilon 1 subunit;
  ENSP ID: ENSP00000453112
MSDIVEKTLTALPGLFLQNQPGGGPAAAKASFSSRLGSLVRGITALTSKHEEEKLIQQELSSLKATVSAPTTTLKMMKECMVRLIYCEMLGYDASFGYIHAIKLAQQGNLLEKRVGYLAVSLFLHESHELLLLLVNTVVKDLQSTNLVEVCMALTVVSQIFPCEMIPAVLPLIEDKLQHSKEIVRRKAVLALYKFHLIAPNQVQHIHIKFRKALCDRDVGVMAASLHIYLRMIKENSSGYKDLTGSFVTILKQVVGGKLPVEFNYHSVPAPWLQIQLLRILGLLGKDDQRTSELMYDVLDESLRRAELNHNVTYAILFECVHTVYSIYPKSELLEKAAKCIGKFVLSPKINLKYLGSYSGSSTPDDNN

SEQ ID NO: 2548 - protein, 453 aa, Homo sapiens
  Payload ID: 607;
  Gene Symbol: AP4M1;
  Gene Name: adaptor-related prt complex 4, mu 1 subunit;
  Uniprot ID:  O00189;
  ENSP ID: ENSP00000352603
MISQFFILSSKGDPLIYKDFRGDSGGRDVAELFYRKLTGLPGDESPVVMHHHGRHFIHIRHSGLYLVVTTSENVSPFSLLELLSRLATLLGDYCGSLGEGTISRNVALVYELLDEVLDYGYVQTTSTEMLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQMDVPGPPGPPSHGLSTSASPLGLGPASLSFELPRHTCSGLQVRFLRLAFRPCGNANPHKWVRHLSHSDAYVIRI

SEQ ID NO: 2549 - protein, 64 aa, Homo sapiens
  Payload ID: 607;
  Gene Symbol: AP4M1;
  Gene Name: adaptor-related prt complex 4, mu 1 subunit;
  ENSP ID: ENSP00000377625
MISQFFILSSKGDPLIYKDFRGDSGGRDVAELFYRKLTGLPGDESPVVMLGVVAGACNPIYSGS

SEQ ID NO: 2550 - protein, 160 aa, Homo sapiens
  Payload ID: 607;
  Gene Symbol: AP4M1;
  Gene Name: adaptor-related prt complex 4, mu 1 subunit;
  ENSP ID: ENSP00000391585
RVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQRPNIVSQLSQACDGAITSRPGRLLVHPAL

SEQ ID NO: 2551 - protein, 138 aa, Homo sapiens
  Payload ID: 607;
  Gene Symbol: AP4M1;
  Gene Name: adaptor-related prt complex 4, mu 1 subunit;
  ENSP ID: ENSP00000393723
  MOD_RES (1)..(1): Any amino acid
XQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQVRFLRLAFRPCGNANPHKWVRHLSHSDAYVIRI

SEQ ID NO: 2552 - protein, 218 aa, Homo sapiens
  Payload ID: 607;
  Gene Symbol: AP4M1;
  Gene Name: adaptor-related prt complex 4, mu 1 subunit;
  ENSP ID: ENSP00000396928
MISQFFILSSKGDPLIYKDFRGDSGGRDVAELFYRKLTGLPGDESPVVMHHHGRHFIHIRHSGLYLVVTTSENVSPFSLLELLSRLATLLGDYCGSLGEGTISRNVALVYELLDEVLDYGYVQTTSTEMLRNFIQTEAVVSKPFSLFDLSSVGLFGAETQQSKVAPSSAASRPVLSSRSDQSQKNEVFLDVVERLSVLIASNVMGQESGSMKSRFTAL

SEQ ID NO: 2553 - protein, 97 aa, Homo sapiens
  Payload ID: 607;
  Gene Symbol: AP4M1;
  Gene Name: adaptor-related prt complex 4, mu 1 subunit;
  ENSP ID: ENSP00000400598
MISQFFILSSKGDPLIYKDFRGDSGGRDVAELFYRKLTGLPGDESPVVMHHHGRHFIHIRHSGLYLVVTTSENVSPFSLLELLSRTMAMYRPHPRRC

SEQ ID NO: 2554 - protein, 311 aa, Homo sapiens
  Payload ID: 607;
  Gene Symbol: AP4M1;
  Gene Name: adaptor-related prt complex 4, mu 1 subunit;
  ENSP ID: ENSP00000401613
MISQFFILSSKGDPLIYKDFRGDSGGRDVAELFYRKLTGLPGDESPVVMDYGYVQTTSTEMLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQ

SEQ ID NO: 2555 - protein, 460 aa, Homo sapiens
  Payload ID: 607;
  Gene Symbol: AP4M1;
  Gene Name: adaptor-related prt complex 4, mu 1 subunit;
  ENSP ID: ENSP00000403663
MISQFFILSSKGDPLIYKDFRGDSGGRDVAELFYRKLTGLPGDESPVVMVTSGGRRHHHGRHFIHIRHSGLYLVVTTSENVSPFSLLELLSRLATLLGDYCGSLGEGTISRNVALVYELLDEVLDYGYVQTTSTEMLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQMDVPGPPGPPSHGLSTSASPLGLGPASLSFELPRHTCSGLQVRFLRLAFRPCGNANPHKWVRHLSHSDAYVIRI

SEQ ID NO: 2556 - protein, 193 aa, Homo sapiens
  Payload ID: 607;
  Gene Symbol: AP4M1;
  Gene Name: adaptor-related prt complex 4, mu 1 subunit;
  ENSP ID: ENSP00000406106
  MOD_RES (1)..(1): Any amino acid
XFHPPVRGDSGGRDVAELFYRKLTGLPGDESPVVMHHHGRHFIHIRHSGLYLVVTTSENVSPFSLLELLSRLATLLGDYCGSLGEGTISRNVALVYELLDEVLDYGYVQTTSTEMLRNFIQTEAVVSKPFSLFDLSSVGLFGAETQQSKVAPSSAASRPVLSSRSDQSQKNEVFLDVVERLSVLIASNRCALA

SEQ ID NO: 2557 - protein, 325 aa, Homo sapiens
  Payload ID: 607;
  Gene Symbol: AP4M1;
  Gene Name: adaptor-related prt complex 4, mu 1 subunit;
  ENSP ID: ENSP00000406676
MLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQMDVPGPPGPPSHGLSTSASPLGLGPASLSFELPRHTCSGLQVRFLRLAFRPCGNANPHKWVRHLSHSDAYVIRI

SEQ ID NO: 2558 - protein, 453 aa, Homo sapiens; identical to SEQ ID NO: 2548
  Payload ID: 607;
  Gene Symbol: AP4M1;
  Gene Name: adaptor-related prt complex 4, mu 1 subunit;
  Uniprot ID:  O00189;
  ENSP ID: ENSP00000412185

SEQ ID NO: 2559 - protein, 265 aa, Homo sapiens
  Payload ID: 607;
  Gene Symbol: AP4M1;
  Gene Name: adaptor-related prt complex 4, mu 1 subunit;
  ENSP ID: ENSP00000414286
MISQFFILSSKGDPLIYKDFRGDSGGRDVAELFYRKLTGLPGDESPVVMHHHGRHFIHIRHSGLYLVVTTSENDYGYVQTTSTEMLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSG

SEQ ID NO: 2560 - protein, 159 aa, Homo sapiens
  Payload ID: 608;
  Gene Symbol: AP4S1;
  Gene Name: adaptor-related prt complex 4, sigma 1 subunit;
  Uniprot ID:  Q9Y587;
  ENSP ID: ENSP00000216366
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVSELDVSFFNTVFHSTWQMHSGPYQEPIDELPKICSALEPQQTCFSPDSSSFKGAASTTPIY

SEQ ID NO: 2561 - protein, 149 aa, Homo sapiens
  Payload ID: 608;
  Gene Symbol: AP4S1;
  Gene Name: adaptor-related prt complex 4, sigma 1 subunit;
  Uniprot ID:  Q9Y587;
  ENSP ID: ENSP00000322508
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVSELDVSFFNTVFHSTWQMHSGPYQTRSCSVTQAGVQRCDHGSLHPGSPGLK

SEQ ID NO: 2562 - protein, 149 aa, Homo sapiens; identical to SEQ ID NO: 2561
  Payload ID: 608;
  Gene Symbol: AP4S1;
  Gene Name: adaptor-related prt complex 4, sigma 1 subunit;
  Uniprot ID:  Q9Y587;
  ENSP ID: ENSP00000334484

SEQ ID NO: 2563 - protein, 144 aa, Homo sapiens
  Payload ID: 608;
  Gene Symbol: AP4S1;
  Gene Name: adaptor-related prt complex 4, sigma 1 subunit;
  Uniprot ID:  Q9Y587;
  ENSP ID: ENSP00000438170
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVSELDIMFNLDKVHIILDEMVLNGCIVETNRARILAPLLILDKMSES

SEQ ID NO: 2564 - protein, 135 aa, Homo sapiens
  Payload ID: 608;
  Gene Symbol: AP4S1;
  Gene Name: adaptor-related prt complex 4, sigma 1 subunit;
  Uniprot ID:  Q9Y587;
  ENSP ID: ENSP00000450768
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVEPIDELPKICSALEPQQTCFSPDSSSFKGAASTTPIY

SEQ ID NO: 2565 - protein, 133 aa, Homo sapiens
  Payload ID: 608;
  Gene Symbol: AP4S1;
  Gene Name: adaptor-related prt complex 4, sigma 1 subunit;
  ENSP ID: ENSP00000451479
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVSELDIMFNLDKVHIILDEMVLNGCIVETNRARILA

SEQ ID NO: 2566 - protein, 7 aa, Homo sapiens
  Payload ID: 608;
  Gene Symbol: AP4S1;
  Gene Name: adaptor-related prt complex 4, sigma 1 subunit;
  ENSP ID: ENSP00000451609
MIKFFLM

SEQ ID NO: 2567 - protein, 83 aa, Homo sapiens
  Payload ID: 608;
  Gene Symbol: AP4S1;
  Gene Name: adaptor-related prt complex 4, sigma 1 subunit;
  ENSP ID: ENSP00000451614
EVIKSCLSRSNEQCSFIEYKDFKLIYRQYAALFIVVGVNDTENEMAIYEFIHNFVEVLDEYFSRVVSLMAKKWFTSSTQFPRN

SEQ ID NO: 2568 - protein, 98 aa, Homo sapiens
  Payload ID: 608;
  Gene Symbol: AP4S1;
  Gene Name: adaptor-related prt complex 4, sigma 1 subunit;
  ENSP ID: ENSP00000451918
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRV

SEQ ID NO: 2569 - protein, 102 aa, Homo sapiens
  Payload ID: 608;
  Gene Symbol: AP4S1;
  Gene Name: adaptor-related prt complex 4, sigma 1 subunit;
  ENSP ID: ENSP00000452383
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVVNNV

SEQ ID NO: 2570 - protein, 144 aa, Homo sapiens; identical to SEQ ID NO: 2563
  Payload ID: 608;
  Gene Symbol: AP4S1;
  Gene Name: adaptor-related prt complex 4, sigma 1 subunit;
  Uniprot ID:  Q9Y587;
  ENSP ID: ENSP00000477631

SEQ ID NO: 2571 - protein, 144 aa, Homo sapiens; identical to SEQ ID NO: 2563
  Payload ID: 608;
  Gene Symbol: AP4S1;
  Gene Name: adaptor-related prt complex 4, sigma 1 subunit;
  Uniprot ID:  Q9Y587;
  ENSP ID: ENSP00000482876

SEQ ID NO: 2572 - protein, 878 aa, Homo sapiens
  Payload ID: 609;
  Gene Symbol: AP5B1;
  Gene Name: adaptor-related prt complex 5, beta 1 subunit;
  Uniprot ID:  Q2VPB7;
  ENSP ID: ENSP00000454303
MGPLSRDAWAQRLGAFRASPSAFMAGPEGEDLGRDLLSDLRSEKLSEQTKVSLLALSMEYPAQLWPDASAAEVAATSLLDTLVLLPPRPSALRRPLLLAATTALAAGGALGPTSGASCRLLPLLLGLAAGSDLGRGFVPASEQRPLQATACECLRELESCKPGLLGGSLGLLRGLLGQEGPVQPLSLLLALALRNTLVLQSRVGAGLGGLLTDKVSPTGGGPWDWTLVEEGDGRLQPQAPSWPAAEEGEGERSLTAREHSPEEARELRAAVIQLLDTSYLLTPVAQAQLLWLLGWALRGLQGQPPALFKPQLVRLLGTAQLTLLHAMLALKAAFGEALFTAQDEALLLRRLTLAAQHPALPPPTHLFYLHCVLSFPENWPLGPEGEEAAPLLLGPQLCRGLLPSLLHDPMALLARLHLLCLLCAEEEEEEKGQLPSPRHYLEELLAGLRQRAALDGGPRALATLCFQASYLVACCLAGQPTVLTPLIHGLAQLYQARPMLAPHFVDLLDQVDSELREPLKVVLRQVVVSRPGRDEALCWHLQMLAKVADGDAQSATLNFLQAAAAHCTNWDLQQGLLRVCRALLRAGVRGGLVDLLQVLARQLEDPDGRDHARLYYILLAHLAAPKLGVALGPSLAAPALASSLVAENQGFVAALMVQEAPALVRLSLGSHRVKGPLPVLKLQPEALEPIYSLELRFRVEGQLYAPLEAVHVPCLCPGRPARPLLLPLQPRCPAPARLDVHALYTTSTGLTCHAHLPPLFVNFADLFLPFPQPPEGAGLGFFEELWDSCLPEGAESRVWCPLGPQGLEGLVSRHLEPFVVVAQPPTSYCVAIHLPPDSKLLLRLEAALADGVPVALRTDDWAVLPLAGDYLRGLAAAV

SEQ ID NO: 2573 - protein, 490 aa, Homo sapiens
  Payload ID: 610;
  Gene Symbol: AP5M1;
  Gene Name: adaptor-related prt complex 5, mu 1 subunit;
  Uniprot ID:  Q9H0R1;
  ENSP ID: ENSP00000261558
MAQRAVWLISHEPGTPLCGTVRFSRRYPTVEKRARVFNGASYVPVPEDGPFLKALLFELRLLDDDKDFVESRDSCSRINKTSIYGLLIGGEELWPVVAFLKNDMIYACVPLVEQTLSPRPPLISVSGVSQGFEFLFGIQDFLYSGQKNDSELNTKLSQLPDLLLQACPFGTLLDANLQNSLDNTNFASVTQPQKQPAWKTGTYKGKPQVSISITEKVKSMQYDKQGIADTWQVVGTVTCKCDLEGIMPNVTISLSLPTNGSPLQDILVHPCVTSLDSAILTSSSIDAMDDSAFSGPYKFPFTPPLESFNLCFYTSQVPVPPILGFYQMKEEEVQLRITINLKLHESVKNNFEFCEAHIPFYNRGPITHLEYKTSFGQLEVFREKSLLIWIIGQKFPKSMEISLSGTVTFGAKSHEKQPFDPICTGETAYLKLHFRILDYTLTGCYADQHSVQVFASGKPKISAHRKLISSDYYIWNSKAPAPVTYGSLLL

SEQ ID NO: 2574 - protein, 504 aa, Homo sapiens
  Payload ID: 610;
  Gene Symbol: AP5M1;
  Gene Name: adaptor-related prt complex 5, mu 1 subunit;
  ENSP ID: ENSP00000390531
MAQRAVWLISHEPGTPLCGTVRFSRDWQEDSGYLSFTIRRYPTVEKRARVFNGASYVPVPEDGPFLKALLFELRLLDDDKDFVESRDSCSRINKTSIYGLLIGGEELWPVVAFLKNDMIYACVPLVEQTLSPRPPLISVSGVSQGFEFLFGIQDFLYSGQKNDSELNTKLSQLPDLLLQACPFGTLLDANLQNSLDNTNFASVTQPQKQPAWKTGTYKGKPQVSISITEKVKSMQYDKQGIADTWQVVGTVTCKCDLEGIMPNVTISLSLPTNGSPLQDILVHPCVTSLDSAILTSSSIDAMDDSAFSGPYKFPFTPPLESFNLCFYTSQVPVPPILGFYQMKEEEVQLRITINLKLHESVKNNFEFCEAHIPFYNRGPITHLEYKTSFGQLEVFREKSLLIWIIGQKFPKSMEISLSGTVTFGAKSHEKQPFDPICTGETAYLKLHFRILDYTLTGCYADQHSVQVFASGKPKISAHRKLISSDYYIWNSKAPAPVTYGSLLL

SEQ ID NO: 2575 - protein, 59 aa, Homo sapiens
  Payload ID: 610;
  Gene Symbol: AP5M1;
  Gene Name: adaptor-related prt complex 5, mu 1 subunit;
  ENSP ID: ENSP00000450422
LHFRILDYTLTGCYADQHSVQVFASGKPKISAHRKLISSDYYIWNSKAPAPVTYGSLLL

SEQ ID NO: 2576 - protein, 38 aa, Homo sapiens
  Payload ID: 610;
  Gene Symbol: AP5M1;
  Gene Name: adaptor-related prt complex 5, mu 1 subunit;
  ENSP ID: ENSP00000451306
MAQRAVWLISHEPGTPLCGTVRFSSVIWKESCQMLPSA

SEQ ID NO: 2577 - protein, 81 aa, Homo sapiens
  Payload ID: 610;
  Gene Symbol: AP5M1;
  Gene Name: adaptor-related prt complex 5, mu 1 subunit;
  ENSP ID: ENSP00000452211
MIYACVPLVEQTLSPRPPLISVSGVSQGFEFLFGIQDFLYSGQKNDSELNTKLSQLPDLLLQACPFGTLLDANLQNSLDNT

SEQ ID NO: 2578 - protein, 93 aa, Homo sapiens
  Payload ID: 610;
  Gene Symbol: AP5M1;
  Gene Name: adaptor-related prt complex 5, mu 1 subunit;
  ENSP ID: ENSP00000473837
  MOD_RES (1)..(1): Any amino acid
XFREKSLLIWIIGQKFPKSMEISLSGTVTFGAKSHEKQPFDPICTGETAYLKLHFRILDYTLTGCYADQHSVQVFASGKPKISARKLHRFKLT

SEQ ID NO: 2579 - protein, 200 aa, Homo sapiens
  Payload ID: 611;
  Gene Symbol: AP5S1;
  Gene Name: adaptor-related prt complex 5, sigma 1 subunit;
  Uniprot ID:  Q9NUS5;
  ENSP ID: ENSP00000246041
MVHAFLIHTLRAPNTEDTGLCRVLYSCVFGAEKSPDDPRPHGAERDRLLRKEQILAVARQVESMCRLQQQASGRPPMDLQPQSSDEQVPLHEAPRGAFRLAAENPFQEPRTVVWLGVLSLGFALVLDAHENLLLAEGTLRLLTRLLLDHLRLLAPSTSLLLRADRIEGILTRFLPHGQLLFLNDQFVQGLEKEFSAAWPR

SEQ ID NO: 2580 - protein, 200 aa, Homo sapiens; identical to SEQ ID NO: 2579
  Payload ID: 611;
  Gene Symbol: AP5S1;
  Gene Name: adaptor-related prt complex 5, sigma 1 subunit;
  Uniprot ID:  Q9NUS5;
  ENSP ID: ENSP00000368886

SEQ ID NO: 2581 - protein, 59 aa, Homo sapiens
  Payload ID: 611;
  Gene Symbol: AP5S1;
  Gene Name: adaptor-related prt complex 5, sigma 1 subunit;
  ENSP ID: ENSP00000368892
MVHAFLIHTLRAPNTEDTGLCRVLYSCVFGAEKSPDDPRPHGAERDRLLRKEQILAVAR

SEQ ID NO: 2582 - protein, 86 aa, Homo sapiens
  Payload ID: 611;
  Gene Symbol: AP5S1;
  Gene Name: adaptor-related prt complex 5, sigma 1 subunit;
  ENSP ID: ENSP00000405487
MVHAFLIHTLRAPNTEDTGLCRVLYSCVFGAEKSPDDPRPHGAERDRLLRKEQILAVARQVESMCRLQQQASGRPPMDLQPQSSDE

SEQ ID NO: 2583 - protein, 200 aa, Homo sapiens; identical to SEQ ID NO: 2579
  Payload ID: 611;
  Gene Symbol: AP5S1;
  Gene Name: adaptor-related prt complex 5, sigma 1 subunit;
  Uniprot ID:  Q9NUS5;
  ENSP ID: ENSP00000481750

SEQ ID NO: 2584 - protein, 807 aa, Homo sapiens
  Payload ID: 612;
  Gene Symbol: AP5Z1;
  Gene Name: adaptor-related prt complex 5, zeta 1 subunit;
  Uniprot ID:  O43299;
  ENSP ID: ENSP00000297562
MFSAGAESLLHQAREIQDEELKKFCSRICKLLQAEDLGPDTLDSLQRLFLIISATKYSRRLEKTCVDLLQATLGLPACPEQLQVLCAAILREMSPSDSLSLAWDHTQNSRQLSLVASVLLAQGDRNEEVRAVGQGVLRALESRQPEGPSLRHLLPVMAKVVVLSPGTLQEDQATLLSKRLVDWLRYASLQQGLPHSGGFFSTPRARQPGPVTEVDGAVATDFFTVLSSGHRFTDDQWLNVQAFSMLRAWLLHSGPEGPGTLDTDDRSEQEGSTLSVISATSSAGRLLPPRERLREVAFEYCQRLIEQSNRRALRKGDSDLQKACLVEAVLVLDVLCRQDPSFLYRSLSCLKALHGRVRGDPASVRVLLPLAHFFLSHGEAAAVDSEAVYQHLFTRIPVEQFHSPMLAFEFIQFCRDNLHLFSGHLSTLRLSFPNLFKFLAWNSPPLTSEFVALLPALVDAGTALEMLHALLDLPCLTAVLDLQLRSAPAASERPLWDTSLRAPSCLEAFRDPQFQGLFQYLLRPKASGATERLAPLHQLLQPMAGCARVAQCAQAVPTLLQAFFSAVTQVADGSLINQLALLLLGRSDSLYPAPGYAAGVHSVLSSQFLALCTLKPSLVVELARDLLEFLGSVNGLCSRASLVTSVVWAIGEYLSVTYDRRCTVEQINKFFEALEALLFEVTQCRPSAALPRCPPQVVTVLMTTLTKLASRSQDLIPRASLLLSKMRTLAHSPATSSTHSEEGAEAIRTRATELLTLLKMPSVAQFVLTPSTEVCSPRYHRDANTALPLALRTVSRLVEREAGLMPG

SEQ ID NO: 2585 - protein, 1536 aa, Homo sapiens
  Payload ID: 613;
  Gene Symbol: ASXL1;
  Gene Name: additional sex combs like transcriptional regulator 1;
  ENSP ID: ENSP00000305119
MGVVNFVFRASEDLQVLENYSDAPMTPKQILQVIEAEGLKEMSGTSPLACLNAMLHSNSRGGEGLFYKLPGRISLFTLKKDALQWSRHPATVEGEEPEDTADVESCGSNEASTVSGENDVSLDETSSNASCSTESQSRPLSNPRDSYRASSQANKQKKKTGVMLPRVVLTPLKVNGAHVESASGFSGCHADGESGSPSSSSSGSLALGSAAIRGQAEVTQDPAPLLRGFRKPATGQMKRNRGEEIDFETPGSILVNTNLRALINSRTFHALPSHFQQQLLFLLPEVDRQVGTDGLLRLSSSALNNEFFTHAAQSWRERLADGEFTHEMQVRIRQEMEKEKKVEQWKEKFFEDYYGQKLGLTKEESLQQNVGQEEAEIKSGLCVPGESVRIQRGPATRQRDGHFKKRSRPDLRTRARRNLYKKQESEQAGVAKDAKSVASDVPLYKDGEAKTDPAGLSSPHLPGTSSAAPDLEGPEFPVESVASRIQAEPDNLARASASPDRIPSLPQETVDQEPKDQKRKSFEQAASASFPEKKPRLEDRQSFRNTIESVHTEKPQPTKEEPKVPPIRIQLSRIKPPWVVKGQPTYQICPRIIPTTESSCRGWTGARTLADIKARALQVRGARGHHCHREAATTAIGGGGGPGGGGGGATDEGGGRGSSSGDGGEACGHPEPRGGPSTPGKCTSDLQRTQLLPPYPLNGEHTQAGTAMSRARREDLPSLRKEESCLLQRATVGLTDGLGDASQLPVAPTGDQPCQALPLLSSQTSVAERLVEQPQLHPDVRTECESGTTSWESDDEEQGPTVPADNGPIPSLVGDDTLEKGTGQALDSHPTMKDPVNVTPSSTPESSPTDCLQNRAFDDELGLGGSCPPMRESDTRQENLKTKALVSNSSLHWIPIPSNDEVVKQPKPESREHIPSVEPQVGEEWEKAAPTPPALPGDLTAEEGLDPLDSLTSLWTVPSRGGSDSNGSYCQQVDIEKLKINGDSEALSPHGESTDTASDFEGHLTEDSSEADTREAAVTKGSSVDKDEKPNWNQSAPLSKVNGDMRLVTRTDGMVAPQSWVSRVCAVRQKIPDSLLLASTEYQPRAVCLSMPGSSVEATNPLVMQLLQGSLPLEKVLPPAHDDSMSESPQVPLTKDQSHGSLRMGSLHGLGKNSGMVDGSSPSSLRALKEPLLPDSCETGTGLARIEATQAPGAPQKNCKAVPSFDSLHPVTNPITSSRKLEEMDSKEQFSSFSCEDQKEVRAMSQDSNSNAAPGKSPGDLTTSRTPRFSSPNVISFGPEQTGRALGDQSNVTGQGKKLFGSGNVAATLQRPRPADPMPLPAEIPPVFPSGKLGPSTNSMSGGVQTPREDWAPKPHAFVGSVKNEKTFVGGPLKANAENRKATGHSPLELVGHLEGMPFVMDLPFWKLPREPGKGLSEPLEPSSLPSQLSIKQAFYGKLSKLQLSSTSFNYSSSSPTFPKGLAGSVVQLSHKANFGASHSASLSLQMFTDSSTVESISLQCACSLKAMIMCQGCGAFCHDDCIGPSKLCVLCLVVR

SEQ ID NO: 2586 - protein, 1541 aa, Homo sapiens
  Payload ID: 613;
  Gene Symbol: ASXL1;
  Gene Name: additional sex combs like transcriptional regulator 1;
  Uniprot ID:  Q8IXJ9;
  ENSP ID: ENSP00000364839
MKDKQKKKKERTWAEAARLVLENYSDAPMTPKQILQVIEAEGLKEMRSGTSPLACLNAMLHSNSRGGEGLFYKLPGRISLFTLKKDALQWSRHPATVEGEEPEDTADVESCGSNEASTVSGENDVSLDETSSNASCSTESQSRPLSNPRDSYRASSQANKQKKKTGVMLPRVVLTPLKVNGAHVESASGFSGCHADGESGSPSSSSSGSLALGSAAIRGQAEVTQDPAPLLRGFRKPATGQMKRNRGEEIDFETPGSILVNTNLRALINSRTFHALPSHFQQQLLFLLPEVDRQVGTDGLLRLSSSALNNEFFTHAAQSWRERLADGEFTHEMQVRIRQEMEKEKKVEQWKEKFFEDYYGQKLGLTKEESLQQNVGQEEAEIKSGLCVPGESVRIQRGPATRQRDGHFKKRSRPDLRTRARRNLYKKQESEQAGVAKDAKSVASDVPLYKDGEAKTDPAGLSSPHLPGTSSAAPDLEGPEFPVESVASRIQAEPDNLARASASPDRIPSLPQETVDQEPKDQKRKSFEQAASASFPEKKPRLEDRQSFRNTIESVHTEKPQPTKEEPKVPPIRIQLSRIKPPWVVKGQPTYQICPRIIPTTESSCRGWTGARTLADIKARALQVRGARGHHCHREAATTAIGGGGGPGGGGGGATDEGGGRGSSSGDGGEACGHPEPRGGPSTPGKCTSDLQRTQLLPPYPLNGEHTQAGTAMSRARREDLPSLRKEESCLLQRATVGLTDGLGDASQLPVAPTGDQPCQALPLLSSQTSVAERLVEQPQLHPDVRTECESGTTSWESDDEEQGPTVPADNGPIPSLVGDDTLEKGTGQALDSHPTMKDPVNVTPSSTPESSPTDCLQNRAFDDELGLGGSCPPMRESDTRQENLKTKALVSNSSLHWIPIPSNDEVVKQPKPESREHIPSVEPQVGEEWEKAAPTPPALPGDLTAEEGLDPLDSLTSLWTVPSRGGSDSNGSYCQQVDIEKLKINGDSEALSPHGESTDTASDFEGHLTEDSSEADTREAAVTKGSSVDKDEKPNWNQSAPLSKVNGDMRLVTRTDGMVAPQSWVSRVCAVRQKIPDSLLLASTEYQPRAVCLSMPGSSVEATNPLVMQLLQGSLPLEKVLPPAHDDSMSESPQVPLTKDQSHGSLRMGSLHGLGKNSGMVDGSSPSSLRALKEPLLPDSCETGTGLARIEATQAPGAPQKNCKAVPSFDSLHPVTNPITSSRKLEEMDSKEQFSSFSCEDQKEVRAMSQDSNSNAAPGKSPGDLTTSRTPRFSSPNVISFGPEQTGRALGDQSNVTGQGKKLFGSGNVAATLQRPRPADPMPLPAEIPPVFPSGKLGPSTNSMSGGVQTPREDWAPKPHAFVGSVKNEKTFVGGPLKANAENRKATGHSPLELVGHLEGMPFVMDLPFWKLPREPGKGLSEPLEPSSLPSQLSIKQAFYGKLSKLQLSSTSFNYSSSSPTFPKGLAGSVVQLSHKANFGASHSASLSLQMFTDSSTVESISLQCACSLKAMIMCQGCGAFCHDDCIGPSKLCVLCLVVR

SEQ ID NO: 2587 - protein, 81 aa, Homo sapiens
  Payload ID: 613;
  Gene Symbol: ASXL1;
  Gene Name: additional sex combs like transcriptional regulator 1;
  ENSP ID: ENSP00000364841
MGVVNFVFRASEDLQVLENYSDAPMTPKQILQVIEAEGLKEMRSGTSPLACLNAMLHSNSRGGEGLFYKLPGRISLFTLKV

SEQ ID NO: 2588 - protein, 85 aa, Homo sapiens
  Payload ID: 613;
  Gene Symbol: ASXL1;
  Gene Name: additional sex combs like transcriptional regulator 1;
  ENSP ID: ENSP00000438654
MKDKQKKKKERTWAEAARLVLENYSDAPMTPKQILQVIEAEGLKEMRSGTSPLACLNAMLHSNSRGGEGLFYKLPGRISLFTLKV

SEQ ID NO: 2589 - protein, 74 aa, Homo sapiens
  Payload ID: 613;
  Gene Symbol: ASXL1;
  Gene Name: additional sex combs like transcriptional regulator 1;
  ENSP ID: ENSP00000451216
  MOD_RES (1)..(1): Any amino acid
XWAEAARLVLENYSDAPMTPKQILQVIEAEGLKEMRSGTSPLACLNAMLHSNSRGGEGLFYKLPGRISLFTLKV

SEQ ID NO: 2590 - protein, 57 aa, Homo sapiens
  Payload ID: 613;
  Gene Symbol: ASXL1;
  Gene Name: additional sex combs like transcriptional regulator 1;
  ENSP ID: ENSP00000480361
MTPKQILQVIEAEGLKEMRSGTSPLACLNAMLHSNSRGGEGLFYKLPGRISLFTLKR

SEQ ID NO: 2591 - protein, 1541 aa, Homo sapiens; identical to SEQ ID NO: 2586
  Payload ID: 613;
  Gene Symbol: ASXL1;
  Gene Name: additional sex combs like transcriptional regulator 1;
  Uniprot ID:  Q8IXJ9;
  ENSP ID: ENSP00000480487

SEQ ID NO: 2592 - protein, 1541 aa, Homo sapiens; identical to SEQ ID NO: 2586
  Payload ID: 613;
  Gene Symbol: ASXL1;
  Gene Name: additional sex combs like transcriptional regulator 1;
  Uniprot ID:  Q8IXJ9;
  ENSP ID: ENSP00000481978

SEQ ID NO: 2593 - protein, 1407 aa, Homo sapiens [sequence omitted]

SEQ ID NO: 2594 - protein, 918 aa, Homo sapiens
  Payload ID: 614;
  Gene Symbol: ASXL2;
  Gene Name: additional sex combs like transcriptional regulator 2;
  Uniprot ID:  Q76L83;
  ENSP ID: ENSP00000383920
MKRTKCADIDVETPDSILVNTNLRALINKHTFSVLPGDCQQRLLLLLPEVDRQVGPDGLMKLNGSALNNEFFTSAAQGWKERLSEGEFTPEMQVRIRQEIEKEKKVEPWKEQFFESYYGQSSGLSLEDSKKLTASPSDPKVKKTPAEQPKSMPVSEASLIRIVPVVSQSECKEEALQMSSPGRKEECESQGEVQPNFSTSSEPLLSSALNTHELSSILPIKCPKDEDLLEQKPVTSAEQESEKNHLTTASNYNKSESQESLVTSPSKPKSPGVEKPIVKPTAGAGPQETNMKEPLATLVDQSPESLKRKSSLTQEEAPVSWEKRPRVTENRQHQQPFQVSPQPFLNRGDRIQVRKVPPLKIPVSRISPMPFHPSQVSPRARFPVSITSPNRTGARTLADIKAKAQLVKAQRAAAAAAAAAAAAASVGGTIPGPGPGGGQGPGEGGEGQTARGGSPGSDRVSETGKGPTLELAGTGSRGGTRELLPCGPETQPQSETKTTPSQAQPHSVSGAQLQQTPPVPPTPAVSGACTSVPSPAHIEKLDNEKLNPTRATATVASVSHPQGPSSCRQEKAPSPTGFQLEDISTSQRFMLGFAGRRTSKPAMAGHYLLNISTYGRGSESFRRTHSVNPEDRFCLSSPTEALKMGYTDCKNATGESSSSKEDDTDEESTGDEQESVTVKEEPQVSQSAGKGDTSSGPHSRETLSTSDCLASKNVKAEIPLNEQTTLSKENYLFTRGQTFDEKTLARDLIQAAQKQMAHAVRGKAIRSSPELFSSTVLPLPADSPTHQPLLLPPLQTPKLYGSPTQIGPSYRGMINVSTSSDMDHNSAVPGSQVSSNVGDVMSFSVTVTTIPASQAMNPSSHGQTIPVQAFSEENSIEGTPSKCYCRLKAMIMCKGCGAFCHDDCIGPSKLCVSCLVVR

SEQ ID NO: 2595 - protein, 1435 aa, Homo sapiens
  Payload ID: 614;
  Gene Symbol: ASXL2;
  Gene Name: additional sex combs like transcriptional regulator 2;
  Uniprot ID:  Q76L83;
  ENSP ID: ENSP00000391447
MREKGRRKKGRTWAEAAKTVLEKYPNTPMSHKEILQVIQREGLKEIRSGTSPLACLNAMLHTNSRGEEGIFYKVPGRMGVYTLKKDVPDGVKELSEGSEESSDGQSDSQSSENSSSSSDGGSNKEGKKSRWKRKVSSSSPQSGCPSPTIPAGKVISPSQKHSKKALKQALKQQQQKKQQQQCRPSISISSNQHLSLKTVKAASDSVPAKPATWEGKQSDGQTGSPQNSNSSFSSSVKVENTLLGLGKKSFQRSERLHTRQMKRTKCADIDVETPDSILVNTNLRALINKHTFSVLPGDCQQRLLLLLPEVDRQVGPDGLMKLNGSALNNEFFTSAAQGWKERLSEGEFTPEMQVRIRQEIEKEKKVEPWKEQFFESYYGQSSGLSLEDSKKLTASPSDPKVKKTPAEQPKSMPVSEASLIRIVPVVSQSECKEEALQMSSPGRKEECESQGEVQPNFSTSSEPLLSSALNTHELSSILPIKCPKDEDLLEQKPVTSAEQESEKNHLTTASNYNKSESQESLVTSPSKPKSPGVEKPIVKPTAGAGPQETNMKEPLATLVDQSPESLKRKSSLTQEEAPVSWEKRPRVTENRQHQQPFQVSPQPFLNRGDRIQVRKVPPLKIPVSRISPMPFHPSQVSPRARFPVSITSPNRTGARTLADIKAKAQLVKAQRAAAAAAAAAAAAASVGGTIPGPGPGGGQGPGEGGEGQTARGGSPGSDRVSETGKGPTLELAGTGSRGGTRELLPCGPETQPQSETKTTPSQAQPHSVSGAQLQQTPPVPPTPAVSGACTSVPSPAHIEKLDNEKLNPTRATATVASVSHPQGPSSCRQEKAPSPTGPALISGASPVHCAADGTVELKAGPSKNIPNPSASSKTDASVPVAVTPSPLTSLLTTATLEKLPVPQVSATTAPAGSAPPSSTLPAASSLKTPGTSLNMNGPTLRPTSSIPANNPLVTQLLQGKDVPMEQILPKPLTKVEMKTVPLTAKEERGMGALIATNTTENSTREEVNERQSHPATQQQLGKTLQSKQLPQVPRPLQLFSAKELRDSSIDTHQYHEGLSKATQDQILQTLIQRVRRQNLLSVVPPSQFNFAHSGFQLEDISTSQRFMLGFAGRRTSKPAMAGHYLLNISTYGRGSESFRRTHSVNPEDRFCLSSPTEALKMGYTDCKNATGESSSSKEDDTDEESTGDEQESVTVKEEPQVSQSAGKGDTSSGPHSRETLSTSDCLASKNVKAEIPLNEQTTLSKENYLFTRGQTFDEKTLARDLIQAAQKQMAHAVRGKAIRSSPELFSSTVLPLPADSPTHQPLLLPPLQTPKLYGSPTQIGPSYRGMINVSTSSDMDHNSAVPGSQVSSNVGDVMSFSVTVTTIPASQAMNPSSHGQTIPVQAFSEENSIEGTPSKCYCRLKAMIMCKGCGAFCHDDCIGPSKLCVSCLVVR

SEQ ID NO: 2596 - protein, 2248 aa, Homo sapiens
  Payload ID: 615;
  Gene Symbol: ASXL3;
  Gene Name: additional sex combs like transcriptional regulator 3;
  Uniprot ID:  Q9C0F0;
  ENSP ID: ENSP00000269197
MKDKRKKKDRTWAEAARLALEKHPNSPMTAKQILEVIQKEGLKETSGTSPLACLNAMLHTNTRIGDGTFFKIPGKSGLYALKKEESSCPADGTLDLVCESELDGTDMAEANAHGEENGVCSKQVTDEASSTRDSSLTNTAVQSKLVSSFQQHTKKALKQALRQQQKRRNGVSMMVNKTVPRVVLTPLKVSDEQSDSPSGSESKNGEADSSDKEMKHGQKSPTGKQTSQHLKRLKKSGLGHLKWTKAEDIDIETPGSILVNTNLRALINKHTFASLPQHFQQYLLLLLPEVDRQMGSDGILRLSTSALNNEFFAYAAQGWKQRLAEGEFTPEMQLRIRQEIEKEKKTEPWKEKFFERFYGEKLGMSREESVKLTTGPNNAGAQSSSSCGTSGLPVSAQTALAEQQPKSMKSPASPEPGFCATLCPMVEIPPKDIMAELESEDILIPEESVIQEEIAEEVETSICECQDENHKTIPEFSEEAESLTNSHEEPQIAPPEDNLESCVMMNDVLETLPHIEVKIEGKSESPQEEMTVVIDQLEVCDSLIPSTSSMTHVSDTEHKESETAVETSTPKIKTGSSSLEGQFPNEGIAIDMELQSDPEEQLSENACISETSFSSESPEGACTSLPSPGGETQSTSEESCTPASLETTFCSEVSSTENTDKYNQRNSTDENFHASLMSEISPISTSPEISEASLMSNLPLTSEASPVSNLPLTSETSPMSDLPLTSETSSVSSMLLTSETTFVSSLPLPSETSPISNSSINERMAHQQRKSPSVSEEPLSPQKDESSATAKPLGENLTSQQKNLSNTPEPIIMSSSSIAPEAFPSEDLHNKTLSQQTCKSHVDTEKPYPASIPELASTEMIKVKNHSVLQRTEKKVLPSPLELSVFSEGTDNKGNELPSAKLQDKQYISSVDKAPFSEGSRNKTHKQGSTQSRLETSHTSKSSEPSKSPDGIRNESRDSEISKRKTAEQHSFGICKEKRARIEDDQSTRNISSSSPPEKEQPPREEPRVPPLKIQLSKIGPPFIIKSQPVSKPESRASTSTSVSGGRNTGARTLADIKARAQQARAQREAAAAAAVAAAASIVSGAMGSPGEGGKTRTLAHIKEQTKAKLFAKHQARAHLFQTSKETRLPPPLSSKEGPPNLEVSSTPETKMEGSTGVIIVNPNCRSPSNKSAHLRETTTVLQQSLNPSKLPETATDLSVHSSDENIPVSHLSEKIVSSTSSENSSVPMLFNKNSVPVSVCSTAISGAIKEHPFVSSVDKSSVLMSVDSANTTISACNISMLKTIQGTDTPCIAIIPKCIESTPISATTEGSSISSSMDDKQLLISSSSASNLVSTQYTSVPTPSIGNNLPNLSTSSVLIPPMGINNRFPSEKIAIPGSEEQATVSMGTTVRAALSCSDSVAVTDSLVAHPTVAMFTGNMLTINSYDSPPKLSAESLDKNSGPRNRADNSGKPQQPPGGFAPAAINRSIPCKVIVDHSTTLTSSLSLTVSVESSEASLDLQGRPVRTEASVQPVACPQVSVISRPEPVANEGIDHSSTFIAASAAKQDSKTLPATCTSLRELPLVPDKLNEPTAPSHNFAEQARGPAPFKSEADTTCSNQYNPSNRICWNDDGMRSTGQPLVTHSGSSKQKEYLEQSCPKAIKTEHANYLNVSELHPRNLVTNVALPVKSELHEADKGFRMDTEDFPGPELPPPAAEGASSVQQTQNMKASTSSPMEEAISLATDALKRVPGAGSSGCRLSSVEANNPLVTQLLQGNLPLEKVLPQPRLGAKLEINRLPLPLQTTSVGKTAPERNVEIPPSSPNPDGKGYLAGTLAPLQMRKRENHPKKRVARTVGEHTQVKCEPGKLLVEPDVKGVPCVISSGISQLGHSQPFKQEWLNKHSMQNRIVHSPEVKQQKRLLPSCSFQQNLFHVDKNGGFHTDAGTSHRQQFYQMPVAARGPIPTAALLQASSKTPVGCNAFAFNRHLEQKGLGEVSLSSAPHQLRLANMLSPNMPMKEGDEVGGTAHTMPNKALVHPPPPPPPPPPPPLALPPPPPPPPPLPPPLPNAEVPSDQKQPPVTMETTKRLSWPQSTGICSNIKSEPLSFEEGLSSSCELGMKQVSYDQNEMKEQLKAFALKSADFSSYLLSEPQKPFTQLAAQKMQVQQQQQLCGNYPTIHFGSTSFKRAASAIEKSIGILGSGSNPATGLSGQNAQMPVQNFADSSNADELELKCSCRLKAMIVCKGCGAFCHDDCIGPSKLCVACLVVR

SEQ ID NO: 2597 - protein, 58 aa, Homo sapiens
  Payload ID: 615;
  Gene Symbol: ASXL3;
  Gene Name: additional sex combs like transcriptional regulator 3;
  ENSP ID: ENSP00000464931
MTAKQILEVIQKEGLKETRPRHGLETALVCMKDLPPMKDLGQLSMMIILEPQLLSCWS

SEQ ID NO: 2598 - protein, 318 aa, Homo sapiens
  Payload ID: 615;
  Gene Symbol: ASXL3;
  Gene Name: additional sex combs like transcriptional regulator 3;
  ENSP ID: ENSP00000465053
MKDKRKKKDRTWAEAARLALEKHPNSPMTAKQILEVIQKEGLKETRNGTSPLACLNAMLHTNTRIGDGTFFKIPGKSGLYALKKEESSCPADGTLDLVCESELDGTDMAEANAHGEENGVCSKQVTDEASSTRDSSLTNTAVQSKLVSSFQQHTKKALKQALRQQQKRRNGVSMMVNKTVPRVVLTPLKVSDEQSDSPSGSESKNGEADSSDKEMKHGQKSPTGKQTSQHLKRLKKSGLGHLKWTKAEDIDIETPGSILVNTNLRALINKHTFASLPQHFQQYLLLLLPEVDRQSRNEPFLQEAMVPISGGCHEIKMS

SEQ ID NO: 2599 - protein, 174 aa, Homo sapiens
  Payload ID: 615;
  Gene Symbol: ASXL3;
  Gene Name: additional sex combs like transcriptional regulator 3;
  ENSP ID: ENSP00000465634
  MOD_RES (1)..(1): Any amino acid
XAEAARLALEKHPNSPMTAKQILEVIQKEGLKETRNGTSPLACLNAMLHTNTRIGDGTFFKIPGKSGLYALKKEESSCPADGTLDLVCESELDGTDMAEANAHGEENGVCSKQVTDEASSTRDSSLTNTAVQSKLVSSFQQHTKKALKQALRQQQKRRNGVSMMVNKTVPRVVL

SEQ ID NO: 2600 - protein, 34 aa, Homo sapiens
  Payload ID: 615;
  Gene Symbol: ASXL3;
  Gene Name: additional sex combs like transcriptional regulator 3;
  ENSP ID: ENSP00000466030
MTAKQILEVIQKEGLKETSLVSDPGMAWRQRWCV

SEQ ID NO: 2601 - protein, 61 aa, Homo sapiens
  Payload ID: 615;
  Gene Symbol: ASXL3;
  Gene Name: additional sex combs like transcriptional regulator 3;
  ENSP ID: ENSP00000466073
MKDKRKKKDRTWAEAARLALEKHPNSPMTAKQILEVIQKEGLKETSLVSDPGMAWRQRWCV

SEQ ID NO: 2602 - protein, 148 aa, Homo sapiens
  Payload ID: 615;
  Gene Symbol: ASXL3;
  Gene Name: additional sex combs like transcriptional regulator 3;
  ENSP ID: ENSP00000466244
MTAKQILEVIQKEGLKETSSGRQKAQIKVGSVRFCGTSPLACLNAMLHTNTRIGDGTFFKIPGKSGLYALKKEESSCPADGTLDLVCESELDGTDMAEANAHGEENGVCSKQVTDEASSTRDSSLTNTAVQSKLVSSFQQHTKKALKQ

SEQ ID NO: 2603 - protein, 58 aa, Homo sapiens; identical to SEQ ID NO: 2597
  Payload ID: 615;
  Gene Symbol: ASXL3;
  Gene Name: additional sex combs like transcriptional regulator 3;
  ENSP ID: ENSP00000466655

SEQ ID NO: 2604 - protein, 34 aa, Homo sapiens
  Payload ID: 615;
  Gene Symbol: ASXL3;
  Gene Name: additional sex combs like transcriptional regulator 3;
  ENSP ID: ENSP00000467648
MTAKQILEVIQKEGLKETSSGRQKAQIKVGSVRF

SEQ ID NO: 2605 - protein, 34 aa, Homo sapiens; identical to SEQ ID NO: 2600
  Payload ID: 615;
  Gene Symbol: ASXL3;
  Gene Name: additional sex combs like transcriptional regulator 3;
  ENSP ID: ENSP00000467907

SEQ ID NO: 2606 - protein, 179 aa, Homo sapiens
  Payload ID: 615;
  Gene Symbol: ASXL3;
  Gene Name: additional sex combs like transcriptional regulator 3;
  ENSP ID: ENSP00000468024
KRKKKDRTWAEAARLALEKHPNSPMTAKQILEVIQKEGLKETSGTSPLACLNAMLHTNTRIGDGTFFKIPGKSGLYALKKEESSCPADGTLDLVCESELDGTDMAEANAHGEENGVCSKQVTDEASSTRDSSLTNTAVQSKLVSSFQQHTKKALKQALRQQQKRRNGVSMMVNKTVPRV

SEQ ID NO: 2607 - protein, 19 aa, Homo sapiens
  Payload ID: 615;
  Gene Symbol: ASXL3;
  Gene Name: additional sex combs like transcriptional regulator 3;
  ENSP ID: ENSP00000468264
MTAKQILEVIQKEGLKETR

SEQ ID NO: 2608 - protein, 58 aa, Homo sapiens; identical to SEQ ID NO: 2597
  Payload ID: 615;
  Gene Symbol: ASXL3;
  Gene Name: additional sex combs like transcriptional regulator 3;
  ENSP ID: ENSP00000468533

SEQ ID NO: 2609 - protein, 768 aa, Homo sapiens
  Payload ID: 616;
  Gene Symbol: ADD1;
  Gene Name: adducin 1 (alpha);
  Uniprot ID:  P35611;
  ENSP ID: ENSP00000264758
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEDLVPEPTTGDDSDAATFKPTLPDLSPDEPSEALGFPMLEKEEEAHRPPSPTEAPTEASPEPAPDPAPVAEEAAPSAVEEGAAADPGSDGSPGKSPSKKKKKFRTPSFLKKSKKKSDS

SEQ ID NO: 2610 - protein, 662 aa, Homo sapiens
  Payload ID: 616;
  Gene Symbol: ADD1;
  Gene Name: adducin 1 (alpha);
  Uniprot ID:  P35611;
  ENSP ID: ENSP00000348100
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKWTKEDGHRTSTSAVPNLFVPLNTNPKEVQEMRNKIREQNLQDIKTAGPQSQVLCGVVMDRSLVQDAPLSDCTETIEGLELTEQTFSPAKSLSFRKGELVTASKAIIEKEYQPHVIVSTTGPNPFTTLTDRELEEYRREVERKQKGSEENLDEAREQKEKSPPDQPAVPHPPPSTPIKLEEGDGCAREYLLP

SEQ ID NO: 2611 - protein, 662 aa, Homo sapiens
  Payload ID: 616;
  Gene Symbol: ADD1;
  Gene Name: adducin 1 (alpha);
  Uniprot ID:  P35611;
  ENSP ID: ENSP00000381191
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEGDGCAREYLLP

SEQ ID NO: 2612 - protein, 662 aa, Homo sapiens; identical to SEQ ID NO: 2611
  Payload ID: 616;
  Gene Symbol: ADD1;
  Gene Name: adducin 1 (alpha);
  Uniprot ID:  P35611;
  ENSP ID: ENSP00000381193

SEQ ID NO: 2613 - protein, 737 aa, Homo sapiens
  Payload ID: 616;
  Gene Symbol: ADD1;
  Gene Name: adducin 1 (alpha);
  Uniprot ID:  P35611;
  ENSP ID: ENSP00000381197
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEDLVPEPTTGDDSDAATFKPTLPDLSPDEPSEALGFPMLEKEEEAHRPPSPTEAPTEASPEPAPDPAPVAEEAAPSAVEEGAAADPGSDGSPGKSPSKKKKKFRTPSFLKKSKKKSDS

SEQ ID NO: 2614 - protein, 400 aa, Homo sapiens [sequence omitted]

SEQ ID NO: 2615 - protein, 632 aa, Homo sapiens
  Payload ID: 616;
  Gene Symbol: ADD1;
  Gene Name: adducin 1 (alpha);
  ENSP ID: ENSP00000421907
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEAGDGCAREYLLP

SEQ ID NO: 2616 - protein, 137 aa, Homo sapiens
  Payload ID: 616;
  Gene Symbol: ADD1;
  Gene Name: adducin 1 (alpha);
  ENSP ID: ENSP00000421918
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIA

SEQ ID NO: 2617 - protein, 663 aa, Homo sapiens
  Payload ID: 616;
  Gene Symbol: ADD1;
  Gene Name: adducin 1 (alpha);
  ENSP ID: ENSP00000423024
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEAGDGCAREYLLP

SEQ ID NO: 2618 - protein, 444 aa, Homo sapiens
  Payload ID: 616;
  Gene Symbol: ADD1;
  Gene Name: adducin 1 (alpha);
  ENSP ID: ENSP00000424143
  MOD_RES (1)..(1): Any amino acid
XVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEDLVPEPTTGDDSDAATFKPTLPDLSPDEPSEALGFPMLEKEEEAHRPPSPTEAPTEASPEPAPDPAPVAEEAAPSAVEEGAAADPGS

SEQ ID NO: 2619 - protein, 69 aa, Homo sapiens
  Payload ID: 616;
  Gene Symbol: ADD1;
  Gene Name: adducin 1 (alpha);
  ENSP ID: ENSP00000425703
MNGDSRAAVVTSPPPTTAPHKERYFDRVDENNPEYLRERNMAPDLRQDFNMMEQKKRVSMILQSPVLVW

SEQ ID NO: 2620 - protein, 142 aa, Homo sapiens
  Payload ID: 616;
  Gene Symbol: ADD1;
  Gene Name: adducin 1 (alpha);
  ENSP ID: ENSP00000426700
MNGDSRAAVVTSPPPTTAPHKERYFDRVDENNPEYLRERNMAPDLRQDFNMMEQKKRVSMILQSPTRVNSEQEHFLIVPFGLLYSEVTASSLVKINLQGDIVDRGSTNLGVNQAGFTLHSAIYAARPDVKCVVHIHTPAGAA

SEQ ID NO: 2621 - protein, 105 aa, Homo sapiens
  Payload ID: 616;
  Gene Symbol: ADD1;
  Gene Name: adducin 1 (alpha);
  ENSP ID: ENSP00000438069
EMRNKIREQNLQDIKTAGPQSQVLCGVVMDRSLVQRIWTRLENRKKRVLQTSLRSPTRLPALPSSWRKTLCRSRLLEMTVMLPPLSQLSPICPLMNLQKHSASQC

SEQ ID NO: 2622 - protein, 114 aa, Homo sapiens
  Payload ID: 616;
  Gene Symbol: ADD1;
  Gene Name: adducin 1 (alpha);
  ENSP ID: ENSP00000441388
  MOD_RES (1)..(1): Any amino acid
XVSTTGPNPFTTLTDRELEEYRREVERKQKGSEENLDEAREQKEKSPPDQPAVPHPPPSTPIKLEEGKTDLYVSCDQTLCRSRLLEMTVMLPPLSQLSPICPLMNLQKHSASQC

SEQ ID NO: 2623 - protein, 726 aa, Homo sapiens
  Payload ID: 617;
  Gene Symbol: ADD2;
  Gene Name: adducin 2 (beta);
  Uniprot ID:  P35612;
  ENSP ID: ENSP00000264436
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPSTESQLMSKGDEDTKDDSEETVPNPFSQLTDQELEEYKKEVERKKLELDGEKETAPEEPGSPAKSAPASPVQSPAKEAETKSPLVSPSKSLEEGTKKTETSKAATTEPETTQPEGVVVNGREEEQTAEEILSKGLSQMTTSADTDVDTSKDKTESVTSGPMSPEGSPSKSPSKKKKKFRTPSFLKKSKKKEKVES

SEQ ID NO: 2624 - protein, 643 aa, Homo sapiens
  Payload ID: 617;
  Gene Symbol: ADD2;
  Gene Name: adducin 2 (beta);
  Uniprot ID:  P35612;
  ENSP ID: ENSP00000347972
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPSTESQLMSKGDEDTKDDSEETVPNPFSQLTDQELEEYKKEVERKKLELDETGQEREPGSGPAVCEFFSVALHIWSNILERKKLPQKSLAHLQSLHLLLQCRAQRRRQRQRAL

SEQ ID NO: 2625 - protein, 726 aa, Homo sapiens; identical to SEQ ID NO: 2623
  Payload ID: 617;
  Gene Symbol: ADD2;
  Gene Name: adducin 2 (beta);
  Uniprot ID:  P35612;
  ENSP ID: ENSP00000384303

SEQ ID NO: 2626 - protein, 726 aa, Homo sapiens; identical to SEQ ID NO: 2623
  Payload ID: 617;
  Gene Symbol: ADD2;
  Gene Name: adducin 2 (beta);
  Uniprot ID:  P35612;
  ENSP ID: ENSP00000384677

SEQ ID NO: 2627 - protein, 559 aa, Homo sapiens
  Payload ID: 617;
  Gene Symbol: ADD2;
  Gene Name: adducin 2 (beta);
  Uniprot ID:  P35612;
  ENSP ID: ENSP00000388072
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPVEQRLPLTGGETCLPSGSSVPGAGLQDP

SEQ ID NO: 2628 - protein, 575 aa, Homo sapiens
  Payload ID: 617;
  Gene Symbol: ADD2;
  Gene Name: adducin 2 (beta);
  Uniprot ID:  P35612;
  ENSP ID: ENSP00000398112
MPRRRVPGANCKPTGKMSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPVEQRLPLTGGETCLPSGSSVPGAGLQDP

SEQ ID NO: 2629 - protein, 17 aa, Homo sapiens
  Payload ID: 617;
  Gene Symbol: ADD2;
  Gene Name: adducin 2 (beta);
  ENSP ID: ENSP00000403722
MSEETVPEAASPPPPQG

SEQ ID NO: 2630 - protein, 226 aa, Homo sapiens
  Payload ID: 617;
  Gene Symbol: ADD2;
  Gene Name: adducin 2 (beta);
  ENSP ID: ENSP00000412357
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCII

SEQ ID NO: 2631 - protein, 142 aa, Homo sapiens
  Payload ID: 617;
  Gene Symbol: ADD2;
  Gene Name: adducin 2 (beta);
  ENSP ID: ENSP00000412681
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYR

SEQ ID NO: 2632 - protein, 332 aa, Homo sapiens
  Payload ID: 617;
  Gene Symbol: ADD2;
  Gene Name: adducin 2 (beta);
  ENSP ID: ENSP00000414546
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKSTESQLMSKGDEDTKDDSEETVPNPFSQLTDQELEEYKKEVERKKLELD

SEQ ID NO: 2633 - protein, 279 aa, Homo sapiens
  Payload ID: 617;
  Gene Symbol: ADD2;
  Gene Name: adducin 2 (beta);
  ENSP ID: ENSP00000430243
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKEVLEMRNKIREQNRQDVKSAGPQSQLLASVIAEKSRSPSTESQLMSKGDEDTKDDSEETVPNPFSQLTDQELEEYKKEVERKKLELDETGQE

SEQ ID NO: 2634 - protein, 674 aa, Homo sapiens
  Payload ID: 618;
  Gene Symbol: ADD3;
  Gene Name: adducin 3 (gamma);
  Uniprot ID:  Q9UEY8;
  ENSP ID: ENSP00000277900
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 2635 - protein, 706 aa, Homo sapiens
  Payload ID: 618;
  Gene Symbol: ADD3;
  Gene Name: adducin 3 (gamma);
  Uniprot ID:  Q9UEY8;
  ENSP ID: ENSP00000348381
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEDAEQELLSDDASSVSQIQSQTQSPQNVPEKLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 2636 - protein, 674 aa, Homo sapiens; identical to SEQ ID NO: 2634
  Payload ID: 618;
  Gene Symbol: ADD3;
  Gene Name: adducin 3 (gamma);
  Uniprot ID:  Q9UEY8;
  ENSP ID: ENSP00000353286

SEQ ID NO: 2637 - protein, 672 aa, Homo sapiens
  Payload ID: 618;
  Gene Symbol: ADD3;
  Gene Name: adducin 3 (gamma);
  ENSP ID: ENSP00000480646
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSQIHGTRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 2638 - protein, 180 aa, Homo sapiens
  Payload ID: 619;
  Gene Symbol: APRT;
  Gene Name: adenine phosphoribosyltransferase;
  Uniprot ID:  P07741;
  ENSP ID: ENSP00000367615
MADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGGTMNAACELLGRLQAEVLECVSLVELTSLKGREKLAPVPFFSLLQYE

SEQ ID NO: 2639 - protein, 134 aa, Homo sapiens
  Payload ID: 619;
  Gene Symbol: APRT;
  Gene Name: adenine phosphoribosyltransferase;
  Uniprot ID:  P07741;
  ENSP ID: ENSP00000397007
MADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGV

SEQ ID NO: 2640 - protein, 162 aa, Homo sapiens
  Payload ID: 619;
  Gene Symbol: APRT;
  Gene Name: adenine phosphoribosyltransferase;
  ENSP ID: ENSP00000455692
  MOD_RES (1)..(1): Any amino acid
XADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGGAGLEHLLSAAQANWGPHPPIPRNHERCL

SEQ ID NO: 2641 - protein, 148 aa, Homo sapiens
  Payload ID: 619;
  Gene Symbol: APRT;
  Gene Name: adenine phosphoribosyltransferase;
  ENSP ID: ENSP00000455749
MADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKLCFSHTEPNYTQRENAVNSFPTRAVSCPPVPQGREPQDNTR

SEQ ID NO: 2642 - protein, 153 aa, Homo sapiens
  Payload ID: 619;
  Gene Symbol: APRT;
  Gene Name: adenine phosphoribosyltransferase;
  ENSP ID: ENSP00000456012
MADSELQLVEQRIRSFPDFPTPGVVFRDISPVLKDPASFRAAIGLLARHLKATHGGRIDYIAGECPVAASRALPPLRAPRAELEIQKDALEPGQRVVVVDDLLATGGTMNAACELLGRLQAEVLECVSLVELTSLKGREKLAPVPFFSLLQYE

SEQ ID NO: 2643 - protein, 63 aa, Homo sapiens
  Payload ID: 619;
  Gene Symbol: APRT;
  Gene Name: adenine phosphoribosyltransferase;
  ENSP ID: ENSP00000456905
MADSELQLVEQRIRSFPDFPTPGVVFRDISPVLKDPASFRAAIGLLARHLKATHGGRIDYIAG

SEQ ID NO: 2644 - protein, 63 aa, Homo sapiens; identical to SEQ ID NO: 2643
  Payload ID: 619;
  Gene Symbol: APRT;
  Gene Name: adenine phosphoribosyltransferase;
  ENSP ID: ENSP00000457964

SEQ ID NO: 2645 - protein, 2303 aa, Homo sapiens
  Payload ID: 620;
  Gene Symbol: APC2;
  Gene Name: adenomatosis polyposis coli 2;
  Uniprot ID:  O95996;
  ENSP ID: ENSP00000233607
MASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELPHVETQFSMQMDLIRQQLEFEAQHIRSLMEERFGTSDEMVQRAQIRASRLEQIDKELLEAQDRVQQTEPQALLAVKSVPVDEDPETEVPTHPEDGTPQPGNSKVEVVFWLLSMLATRDQEDTARTLLAMSSSPESCVAMRRSGCLPLLLQILHGTEAAAGGRAGAPGAPGAKDARMRANAALHNIVFSQPDQGLARKEMRVLHVLEQIRAYCETCWDWLQARDGGPEGGGAGSAPIPIEPQICQATCAVMKLSFDEEYRRAMNELGGLQAVAELLQVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 2646 - protein, 730 aa, Homo sapiens
  Payload ID: 620;
  Gene Symbol: APC2;
  Gene Name: adenomatosis polyposis coli 2;
  ENSP ID: ENSP00000238483
MASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELPHVETFSMQMDLIRQQLEFEAQHIRSLMEERFGTSDEMVQRAQIRASRLEQIDKELLEAQDRVQQTEPQALLAVKSVPVDEDPETEVPTHPEDGTPQPGNSKVEVVFWLLSMLATRDQEDTARTLLAMSSSPESCVAMRRSGCLPLLLQILHGTEAAAGGRAGAPGAPGAKDARMRANAALHNIVFSQPDQGLARKEMRVLHVLEQIRAYCETCWDWLQARDGGPEGGGAGSAPIPIEPQICQATCAVMKLSFDEEYRRAMNELGGLQAVAELLQVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELD

SEQ ID NO: 2647 - protein, 2303 aa, Homo sapiens; identical to SEQ ID NO: 2645
  Payload ID: 620;
  Gene Symbol: APC2;
  Gene Name: adenomatosis polyposis coli 2;
  Uniprot ID:  O95996;
  ENSP ID: ENSP00000442954

SEQ ID NO: 2648 - protein, 193 aa, Homo sapiens
  Payload ID: 620;
  Gene Symbol: APC2;
  Gene Name: adenomatosis polyposis coli 2;
  ENSP ID: ENSP00000466173
MASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELPHVETFSMQMDLIRQQLEFEAQHI

SEQ ID NO: 2649 - protein, 170 aa, Homo sapiens
  Payload ID: 620;
  Gene Symbol: APC2;
  Gene Name: adenomatosis polyposis coli 2;
  ENSP ID: ENSP00000466803
MASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELP

SEQ ID NO: 2650 - protein, 702 aa, Homo sapiens
  Payload ID: 620;
  Gene Symbol: APC2;
  Gene Name: adenomatosis polyposis coli 2;
  ENSP ID: ENSP00000467073
MASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELPHVETQFSMQMDLIRQQLEFEAQHIRSLMEERFGTSDEMVQRAQIRASRLEQIDKELLEAQDRVQQTEPQALLAVKSVPVDEDPETEVPTHPEDGTPQPGNSKVEVVFWLLSMLATRDQEDTARTLLAMSSSPESCVAMRRSGCLPLLLQILHGTEAAAGGRAGAPGAPGAKDARMRANAALHNIVFSQPDQGLARKEMRVLHVLEQIRAYCETCWDWLQARDGGPEGGGAGSAPIPIEPQICQATCAVMKLSFDEEYRRAMNELGGLQAVAELLQVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKH

SEQ ID NO: 2651 - protein, 138 aa, Homo sapiens
  Payload ID: 620;
  Gene Symbol: APC2;
  Gene Name: adenomatosis polyposis coli 2;
  ENSP ID: ENSP00000468199
MASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRER

SEQ ID NO: 2652 - protein, 514 aa, Homo sapiens
  Payload ID: 621;
  Gene Symbol: APCDD1;
  Gene Name: adenomatosis polyposis coli down-regulated 1;
  Uniprot ID:  Q8J025;
  ENSP ID: ENSP00000347433
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 2653 - protein, 61 aa, Homo sapiens
  Payload ID: 621;
  Gene Symbol: APCDD1;
  Gene Name: adenomatosis polyposis coli down-regulated 1;
  ENSP ID: ENSP00000404930
MSWPRRLLLRYLFPALLLHEPRPCLHRLSDHLSVRRAPPSHPAPKGRPDHRPARGVGEPAL

SEQ ID NO: 2654 - protein, 184 aa, Homo sapiens
  Payload ID: 621;
  Gene Symbol: APCDD1;
  Gene Name: adenomatosis polyposis coli down-regulated 1;
  ENSP ID: ENSP00000463104
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQGHGRHRVRVQSESHEGHPHGCGHSLTAQRLQRE

SEQ ID NO: 2655 - protein, 22 aa, Homo sapiens
  Payload ID: 621;
  Gene Symbol: APCDD1;
  Gene Name: adenomatosis polyposis coli down-regulated 1;
  ENSP ID: ENSP00000463110
MSWPRRLLLRYLFPALLLHAVK

SEQ ID NO: 2656 - protein, 94 aa, Homo sapiens
  Payload ID: 621;
  Gene Symbol: APCDD1;
  Gene Name: adenomatosis polyposis coli down-regulated 1;
  ENSP ID: ENSP00000464649
PEDVLPALQLPAPSAECQVEMGFHHVGQDGLQLPTSSDPPALASQSAGITGVSHRPPGRHLSNDLRTTTMPASPVGSSIGQTSTTLPSCPQRQT

SEQ ID NO: 2657 - protein, 227 aa, Homo sapiens
  Payload ID: 621;
  Gene Symbol: APCDD1;
  Gene Name: adenomatosis polyposis coli down-regulated 1;
  ENSP ID: ENSP00000476491
  MOD_RES (1)..(1): Any amino acid
XDVAYDLWREENGCECTKAVNFAMHELQLIRVEKQYLHHNLDHLVEELFLGDIHTDATQRMFYRPSSYQPPLQNAKCAAESSGSFQILPQDSSEKEQNGLSHWCLSRPGHQKDWALCAHAGPATAGCPSCLWPPAETGRKAGRTSSKTVHACPGEAGTSSFELFYFPNCWSIETKLKISLNAKLSFKPRASAPLETGHRVKIETLSQLVFLSFIQLCCEVQSPLANK

SEQ ID NO: 2658 - protein, 501 aa, Homo sapiens
  Payload ID: 622;
  Gene Symbol: APCDD1L;
  Gene Name: adenomatosis polyposis coli down-regulated 1-like;
  Uniprot ID:  Q8NCL9;
  ENSP ID: ENSP00000360191
MPAAMLPYACVLVLLGAHTAPAAGEAGGSCLRWEPHCQQPLPDRVPSTAILPPRLNGPWISTGCEVRPGPEFLTRAYTFYPSRLFRAHQFYYEDPFCGEPAHSLLVKGKVRLRRASWVTRGATEADYHLHKVGIVFHSRRALVDVTGRLNQTRAGRDCARRLPPARAWLPGALYELRSARAQGDCLEALGLTMHELSLVRVQRRLQPQPRASPRLVEELYLGDIHTDPAERRHYRPTGYQRPLQSALHHVQPCPACGLIARSDVHHPPVLPPPLALPLHLGGWWVSSGCEVRPAVLFLTRLFTFHGHSRSWEGYYHHFSDPACRQPTFTVYAAGRYTRGTPSTRVRGGTELVFEVTRAHVTPMDQVTTAMLNFSEPSSCGGAGAWSMGTERDVTATNGCLPLGIRLPHVEYELFKMEQDPLGQSLLFIGQRPTDGSSPDTPEKRPTSYQAPLVLCHGEAPDFSRPPQHRPSLQKHPSTGGLHIAPFPLLPLVLGLAFLHWL

SEQ ID NO: 2659 - protein, 80 aa, Homo sapiens
  Payload ID: 622;
  Gene Symbol: APCDD1L;
  Gene Name: adenomatosis polyposis coli down-regulated 1-like;
  ENSP ID: ENSP00000396856
MAENSGPGVRPPGWEAQINIISTRLALAHTAPAAGEAGGSCLRWEPHCQQPLPDRVPSTAILPPRLNGPWISTGCEVRPG

SEQ ID NO: 2660 - protein, 2843 aa, Homo sapiens
  Payload ID: 623;
  Gene Symbol: APC;
  Gene Name: adenomatous polyposis coli;
  Uniprot ID:  P25054;
  ENSP ID: ENSP00000257430
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKVFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 2661 - protein, 1135 aa, Homo sapiens
  Payload ID: 623;
  Gene Symbol: APC;
  Gene Name: adenomatous polyposis coli;
  ENSP ID: ENSP00000423224
MYASLGSGPVAPLPASVPPSVLGSWSTGGSRSCVRQETKSPGGARTSGHWASVWQEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQH

SEQ ID NO: 2662 - protein, 1304 aa, Homo sapiens
  Payload ID: 623;
  Gene Symbol: APC;
  Gene Name: adenomatous polyposis coli;
  ENSP ID: ENSP00000423828
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQI

SEQ ID NO: 2663 - protein, 287 aa, Homo sapiens
  Payload ID: 623;
  Gene Symbol: APC;
  Gene Name: adenomatous polyposis coli;
  ENSP ID: ENSP00000424265
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQIEKMRMFEC

SEQ ID NO: 2664 - protein, 118 aa, Homo sapiens
  Payload ID: 623;
  Gene Symbol: APC;
  Gene Name: adenomatous polyposis coli;
  ENSP ID: ENSP00000426541
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSF

SEQ ID NO: 2665 - protein, 2843 aa, Homo sapiens; identical to SEQ ID NO: 2660
  Payload ID: 623;
  Gene Symbol: APC;
  Gene Name: adenomatous polyposis coli;
  Uniprot ID:  P25054;
  ENSP ID: ENSP00000427089

SEQ ID NO: 2666 - protein, 272 aa, Homo sapiens
  Payload ID: 623;
  Gene Symbol: APC;
  Gene Name: adenomatous polyposis coli;
  ENSP ID: ENSP00000473355
LSFDEEHRHAMNELGRKATRGISSQELGQGLSGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKN

SEQ ID NO: 2667 - protein, 58 aa, Homo sapiens
  Payload ID: 623;
  Gene Symbol: APC;
  Gene Name: adenomatous polyposis coli;
  ENSP ID: ENSP00000481752
MYASLGSGPVAPLPASVPPSVLGSWSTGGSRSCVRQETKSPGGARTSGHWASVWQVQG

SEQ ID NO: 2668 - protein, 51 aa, Homo sapiens
  Payload ID: 623;
  Gene Symbol: APC;
  Gene Name: adenomatous polyposis coli;
  ENSP ID: ENSP00000484935
  MOD_RES (1)..(1): Any amino acid
XPAPVEHQICPAVCVLMKLSFDEEHRHAMNELGINPQKRIECLMEFVSTLH

SEQ ID NO: 2669 - protein, 326 aa, Homo sapiens
  Payload ID: 624;
  Gene Symbol: ADORA1;
  Gene Name: adenosine A1 receptor;
  Uniprot ID:  P30542;
  ENSP ID: ENSP00000308549
MPPSISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRYKMVVTPRRAAVAIAGCWILSFVVGLTPMFGWNNLSAVERAWAANGSMGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPSCHKPSILTYIAIFLTHGNSAMNPIVYAFRIQKFRVTFLKIWNDHFRCQPAPPIDEDLPEERPDD

SEQ ID NO: 2670 - protein, 326 aa, Homo sapiens; identical to SEQ ID NO: 2669
  Payload ID: 624;
  Gene Symbol: ADORA1;
  Gene Name: adenosine A1 receptor;
  Uniprot ID:  P30542;
  ENSP ID: ENSP00000338435

SEQ ID NO: 2671 - protein, 125 aa, Homo sapiens
  Payload ID: 624;
  Gene Symbol: ADORA1;
  Gene Name: adenosine A1 receptor;
  Uniprot ID:  P30542;
  ENSP ID: ENSP00000356204
MPPSISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRRISQCMASTKS

SEQ ID NO: 2672 - protein, 326 aa, Homo sapiens; identical to SEQ ID NO: 2669
  Payload ID: 624;
  Gene Symbol: ADORA1;
  Gene Name: adenosine A1 receptor;
  Uniprot ID:  P30542;
  ENSP ID: ENSP00000356205

SEQ ID NO: 2673 - protein, 210 aa, Homo sapiens
  Payload ID: 624;
  Gene Symbol: ADORA1;
  Gene Name: adenosine A1 receptor;
  ENSP ID: ENSP00000483953
MVVTPRRAAVAIAGCWILSFVVGLTPMFGWNNLSAVERAWAANGSMGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPSCHKPSILTYIAIFLTHGNSAMNPIVYAFRIQKFRVTFLKIWNDHFRCQPAPPIDEDLPEERPDD

SEQ ID NO: 2674 - protein, 412 aa, Homo sapiens
  Payload ID: 625;
  Gene Symbol: ADORA2A;
  Gene Name: adenosine A2a receptor;
  Uniprot ID:  P29274;
  ENSP ID: ENSP00000336630
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGLVSGGSAQESQGNTGLPDVELLSHELKGVCPEPPGLDDPLAQDGAGVS

SEQ ID NO: 2675 - protein, 64 aa, Homo sapiens
  Payload ID: 625;
  Gene Symbol: ADORA2A;
  Gene Name: adenosine A2a receptor;
  ENSP ID: ENSP00000397071
MPIMGSSVYITVELAIAVLAILGNVLVCWAVWLNSNLQNVTNYFVVSLAAADIAVGVLAIPFAI

SEQ ID NO: 2676 - protein, 76 aa, Homo sapiens
  Payload ID: 625;
  Gene Symbol: ADORA2A;
  Gene Name: adenosine A2a receptor;
  ENSP ID: ENSP00000400190
MPIMGSSVYITVELAIAVLAILGNVLVCWAVWLNSNLQNVTNYFVVSLAAADIAVGVLAIPFAITISTGFCAACHG

SEQ ID NO: 2677 - protein, 87 aa, Homo sapiens
  Payload ID: 625;
  Gene Symbol: ADORA2A;
  Gene Name: adenosine A2a receptor;
  ENSP ID: ENSP00000404497
MPIMGSSVYITVELAIAVLAILGNVLVCWAVWLNSNLQNVTNYFVVSLAAADIAVGVLAIPFAITISTGFCAACHGCLFIACFVLVL

SEQ ID NO: 2678 - protein, 365 aa, Homo sapiens
  Payload ID: 625;
  Gene Symbol: ADORA2A;
  Gene Name: adenosine A2a receptor;
  ENSP ID: ENSP00000414802
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGL

SEQ ID NO: 2679 - protein, 108 aa, Homo sapiens
  Payload ID: 625;
  Gene Symbol: ADORA2A;
  Gene Name: adenosine A2a receptor;
  ENSP ID: ENSP00000473799
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRI

SEQ ID NO: 2680 - protein, 83 aa, Homo sapiens
  Payload ID: 625;
  Gene Symbol: ADORA2A;
  Gene Name: adenosine A2a receptor;
  ENSP ID: ENSP00000474097
MPIMGSSVYITVELAIAVLAILGNVLVCWAVWLNSNLQNVTNYFVVSLAAADIAVGVLAIPFAITISTGFCAACHGCLFIACF

SEQ ID NO: 2681 - protein, 6 aa, Homo sapiens
  Payload ID: 625;
  Gene Symbol: ADORA2A;
  Gene Name: adenosine A2a receptor;
  ENSP ID: ENSP00000474895
MPIMGS

SEQ ID NO: 2682 - protein, 29 aa, Homo sapiens
  Payload ID: 625;
  Gene Symbol: ADORA2A;
  Gene Name: adenosine A2a receptor;
  ENSP ID: ENSP00000475000
MPIMGSSVYITVELAIAVLAILGNVLVCW

SEQ ID NO: 2683 - protein, 332 aa, Homo sapiens
  Payload ID: 626;
  Gene Symbol: ADORA2B;
  Gene Name: adenosine A2b receptor;
  Uniprot ID:  P29275;
  ENSP ID: ENSP00000304501
MLLETQDALYVALELVIAALSVAGNVLVCAAVGTANTLQTPTNYFLVSLAAADVAVGLFAIPFAITISLGFCTDFYGCLFLACFVLVLTQSSIFSLLAVAVDRYLAICVPLRYKSLVTGTRARGVIAVLWVLAFGIGLTPFLGWNSKDSATNNCTEPWDGTTNESCCLVKCLFENVVPMSYMVYFNFFGCVLPPLLIMLVIYIKIFLVACRQLQRTELMDHSRTTLQREIHAAKSLAMIVGIFALCWLPVHAVNCVTLFQPAQGKNKPKWAMNMAILLSHANSVVNPIVYAYRNRDFRYTFHKIISRYLLCQADVKSGNGQAGVQPALGVGL

SEQ ID NO: 2684 - protein, 318 aa, Homo sapiens
  Payload ID: 627;
  Gene Symbol: ADORA3;
  Gene Name: adenosine A3 receptor;
  Uniprot ID:  P0DMS8;
  ENSP ID: ENSP00000241356
MPNNSTALSLANVTYITMEIFIGLCAIVGNVLVICVVKLNPSLQTTTFYFIVSLALADIAVGVLVMPLAIVVSLGITIHFYSCLFMTCLLLIFTHASIMSLLAIAVDRYLRVKLTVRYKRVTTHRRIWLALGLCWLVSFLVGLTPMFGWNMKLTSEYHRNVTFLSCQFVSVMRMDYMVYFSFLTWIFIPLVVMCAIYLDIFYIIRNKLSLNLSNSKETGAFYGREFKTAKSLFLVLFLFALSWLPLSIINCIIYFNGEVPQLVLYMGILLSHANSMMNPIVYAYKIKKFKETYLLILKACVVCHPSDSLDTSIEKNSE

SEQ ID NO: 2685 - protein, 123 aa, Homo sapiens
  Payload ID: 627;
  Gene Symbol: ADORA3;
  Gene Name: adenosine A3 receptor;
  ENSP ID: ENSP00000488073
MPNNSTALSLANVTYITMEIFIGLCAIVGNVLVICVVKLNPSLQTTTFYFIVSLALADIAVGVLVMPLAIVVSLGITIHFYSCLFMTCLLLIFTHASIMSLLAIAVDRYLRVKLTVSSISPTL

SEQ ID NO: 2686 - protein, 363 aa, Homo sapiens
  Payload ID: 628;
  Gene Symbol: ADA;
  Gene Name: adenosine deaminase;
  Uniprot ID:  P00813;
  ENSP ID: ENSP00000361965
MAQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQEAVKSGIHRTVHAGEVGSAEVVKEAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNL

SEQ ID NO: 2687 - protein, 263 aa, Homo sapiens
  Payload ID: 628;
  Gene Symbol: ADA;
  Gene Name: adenosine deaminase;
  ENSP ID: ENSP00000440946
MAQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQEAVKSGIHRTVHAGEVGSAEVVKEAVDILKTERLGHGYHTLEDQALYNRLRQENMHFEAQK

SEQ ID NO: 2688 - protein, 339 aa, Homo sapiens
  Payload ID: 628;
  Gene Symbol: ADA;
  Gene Name: adenosine deaminase;
  ENSP ID: ENSP00000441818
MAQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNL

SEQ ID NO: 2689 - protein, 75 aa, Homo sapiens
  Payload ID: 628;
  Gene Symbol: ADA;
  Gene Name: adenosine deaminase;
  ENSP ID: ENSP00000446464
MAQTPAFDKPKVELHVHLDGSIKPETILYYGRRRGIALPANTAEGLLNVIGMDKPLTLPDFLAKFDYYMPAIARL

SEQ ID NO: 2690 - protein, 576 aa, Homo sapiens
  Payload ID: 629;
  Gene Symbol: ADAD1;
  Gene Name: adenosine deaminase domain containing 1 (testis-specific);
  Uniprot ID:  Q96M93;
  ENSP ID: ENSP00000296513
MASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIERAGQHEVVAIGTGEYNYSQDIKPDGRVLHDTHAVVTARRSLLRYFYRQLLLFYSKNPAMMEKSIFCTEPTSNLLTLKQNINICLYMNQLPKGSAQIKSQLRLNPHSISAFEANEELCLHVAVEGKIYLTVYCPKDGVNRISSMSSSDKLTRWEVLGVQGALLSHFIQPVYISSILIGDGNCSDTRGLEIAIKQRVDDALTSKLPMFYLVNRPHISLVPSAYPLQMNLEYKFLSLNWAQGDVSLEIVDGLSGKITESSPFKSGMSMASRLCKAAMLSRFNLLAKEAKKELLEAGTYHAAKCMSASYQEAKCKLKSYLQQHGYGSWIVKSPCIEQFNM

SEQ ID NO: 2691 - protein, 565 aa, Homo sapiens
  Payload ID: 629;
  Gene Symbol: ADAD1;
  Gene Name: adenosine deaminase domain containing 1 (testis-specific);
  Uniprot ID:  Q96M93;
  ENSP ID: ENSP00000373376
MASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIERAGQHEVVAIGTGEYNYSQDIKPDGRVLHDTHAVVTARRSLLSKNPAMMEKSIFCTEPTSNLLTLKQNINICLYMNQLPKGSAQIKSQLRLNPHSISAFEANEELCLHVAVEGKIYLTVYCPKDGVNRISSMSSSDKLTRWEVLGVQGALLSHFIQPVYISSILIGDGNCSDTRGLEIAIKQRVDDALTSKLPMFYLVNRPHISLVPSAYPLQMNLEYKFLSLNWAQGDVSLEIVDGLSGKITESSPFKSGMSMASRLCKAAMLSRFNLLAKEAKKELLEAGTYHAAKCMSASYQEAKCKLKSYLQQHGYGSWIVKSPCIEQFNM

SEQ ID NO: 2692 - protein, 558 aa, Homo sapiens
  Payload ID: 629;
  Gene Symbol: ADAD1;
  Gene Name: adenosine deaminase domain containing 1 (testis-specific);
  Uniprot ID:  Q96M93;
  ENSP ID: ENSP00000373377
MLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIERAGQHEVVAIGTGEYNYSQDIKPDGRVLHDTHAVVTARRSLLRYFYRQLLLFYSKNPAMMEKSIFCTEPTSNLLTLKQNINICLYMNQLPKGSAQIKSQLRLNPHSISAFEANEELCLHVAVEGKIYLTVYCPKDGVNRISSMSSSDKLTRWEVLGVQGALLSHFIQPVYISSILIGDGNCSDTRGLEIAIKQRVDDALTSKLPMFYLVNRPHISLVPSAYPLQMNLEYKFLSLNWAQGDVSLEIVDGLSGKITESSPFKSGMSMASRLCKAAMLSRFNLLAKEAKKELLEAGTYHAAKCMSASYQEAKCKLKSYLQQHGYGSWIVKSPCIEQFNM

SEQ ID NO: 2693 - protein, 156 aa, Homo sapiens
  Payload ID: 629;
  Gene Symbol: ADAD1;
  Gene Name: adenosine deaminase domain containing 1 (testis-specific);
  ENSP ID: ENSP00000390510
MASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAK

SEQ ID NO: 2694 - protein, 241 aa, Homo sapiens
  Payload ID: 629;
  Gene Symbol: ADAD1;
  Gene Name: adenosine deaminase domain containing 1 (testis-specific);
  ENSP ID: ENSP00000397254
MASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIER

SEQ ID NO: 2695 - protein, 665 aa, Homo sapiens
  Payload ID: 630;
  Gene Symbol: ADAD2;
  Gene Name: adenosine deaminase domain containing 2;
  Uniprot ID:  Q8NCV1;
  ENSP ID: ENSP00000268624
MASASQGADDDGSRRKPRLAASLQISPQPRPWRPLPAQAQSAWGPAPAPATYRAEGGWPQVSVLRDSGPGAGAGVGELGAARAWENLGEQMGKAPRVPVPPAGLSLPLKDPPASQAVSLLTEYAASLGIFLLFREDQPPGKVFKYRAPGGEELKAMCLWQVEVLRAFLLRTGWRGLWRGDLDLGPDSSWANRLPFLLICEMESRIPAVEELGPCFPFSVSAELDGVVCPAGTANSKTEAKQQAALSALCYIRSQLENPESPQTSSRPPLAPLSVENILTHEQRCAALVSAGFDLLLDERSPYWACKGTVAGVILERGWAVSAPSCTEIPRARGHVKEIYKLVALGTGSSCCAGWLEFSGQQLHDCHGLVIARRALLRFLFRQLLLATQGGPKGKEQSVLAPQPGPGPPFTLKPRVFLHLYISNTPKGAARDIYLPPTSEGGLPHSPPMRLQAHVLGQLKPVCYVAPSLCDTHVGCLSASDKLARWAVLGLGGALLAHLVSPLYSTSLILADSCHDPPTLSRAIHTRPCLDSVLGPCLPPPYVRTALHLFAGPPVAPSEPTPDTCRGLSLNWSLGDPGIEVVDVATGRVKANAALGPPSRLCKASFLRAFHQAARAVGKPYLLALKTYEAAKAGPYQEARRQLSLLLDQQGLGAWPSKPLVGKFRN

SEQ ID NO: 2696 - protein, 583 aa, Homo sapiens
  Payload ID: 630;
  Gene Symbol: ADAD2;
  Gene Name: adenosine deaminase domain containing 2;
  Uniprot ID:  Q8NCV1;
  ENSP ID: ENSP00000325153
MASASQGADDDGSRRKPRLAASLQISPQPRPWRPLPAQAQSAWGPAPAPATYRAEGGWPQVSVLRDSGPGAGAGVGELGAARAWENLGEQMGKAPRVPVPPAGLSLPLKDPPASQAVSLLTEYAASLGIFLLFREDQPPGPCFPFSVSAELDGVVCPAGTANSKTEAKQQAALSALCYIRSQLENPESPQTSSRPPLAPLSVENILTHEQRCAALVSAGFDLLLDERSPYWACKGTVAGVILEREIPRARGHVKEIYKLVALGTGSSCCAGWLEFSGQQLHDCHGLVIARRALLRFLFRQLLLATQGGPKGKEQSVLAPQPGPGPPFTLKPRVFLHLYISNTPKGAARDIYLPPTSEGGLPHSPPMRLQAHVLGQLKPVCYVAPSLCDTHVGCLSASDKLARWAVLGLGGALLAHLVSPLYSTSLILADSCHDPPTLSRAIHTRPCLDSVLGPCLPPPYVRTALHLFAGPPVAPSEPTPDTCRGLSLNWSLGDPGIEVVDVATGRVKANAALGPPSRLCKASFLRAFHQAARAVGKPYLLALKTYEAAKAGPYQEARRQLSLLLDQQGLGAWPSKPLVGKFRN

SEQ ID NO: 2697 - protein, 267 aa, Homo sapiens
  Payload ID: 630;
  Gene Symbol: ADAD2;
  Gene Name: adenosine deaminase domain containing 2;
  ENSP ID: ENSP00000454950
  MOD_RES (1)..(1): Any amino acid
XELGAARAWENLGEQMGKAPRVPVPPAGLSLPLKDPPASQAVSLLTEYAASLGIFLLFREDQPPGPCFPFSVSAELDGVVCPAGTANSKTEAKQQAALSALCYIRSQLENPENILTHEQRCAALVSAGFDLLLDERSPYWACKGTVAGVILEREIPRARGHVKEIYKLVALGTGSSCCAGWLEFSGQQLHDCHGLVIARRALLRFLFRQLLLATQGGPKGKEQSVLAPQPGPGPPFTLKPRVFLHLYISNTPKGAARDIYLPPTSEG

SEQ ID NO: 2698 - protein, 931 aa, Homo sapiens
  Payload ID: 631;
  Gene Symbol: ADAR;
  Gene Name: adenosine deaminase, RNA-specific;
  Uniprot ID:  P55265;
  ENSP ID: ENSP00000357456
MAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 2699 - protein, 1226 aa, Homo sapiens
  Payload ID: 631;
  Gene Symbol: ADAR;
  Gene Name: adenosine deaminase, RNA-specific;
  Uniprot ID:  P55265;
  ENSP ID: ENSP00000357459
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 2700 - protein, 1195 aa, Homo sapiens
  Payload ID: 631;
  Gene Symbol: ADAR;
  Gene Name: adenosine deaminase, RNA-specific;
  ENSP ID: ENSP00000431794
GYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTELPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 2701 - protein, 701 aa, Homo sapiens
  Payload ID: 632;
  Gene Symbol: ADARB1;
  Gene Name: adenosine deaminase, RNA-specific, B1;
  Uniprot ID:  P78563;
  ENSP ID: ENSP00000015877
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 2702 - protein, 741 aa, Homo sapiens
  Payload ID: 632;
  Gene Symbol: ADARB1;
  Gene Name: adenosine deaminase, RNA-specific, B1;
  Uniprot ID:  P78563;
  ENSP ID: ENSP00000353920
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEGSRSYTQAGVQWCNHGSLQPRPPGLLSDPSTSTFQGAGTTEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 2703 - protein, 714 aa, Homo sapiens
  Payload ID: 632;
  Gene Symbol: ADARB1;
  Gene Name: adenosine deaminase, RNA-specific, B1;
  Uniprot ID:  P78563;
  ENSP ID: ENSP00000374513
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEGSRSYTQAGVQWCNHGSLQPRPPGLLSDPSTSTFQGAGTTEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKVH

SEQ ID NO: 2704 - protein, 141 aa, Homo sapiens
  Payload ID: 632;
  Gene Symbol: ADARB1;
  Gene Name: adenosine deaminase, RNA-specific, B1;
  ENSP ID: ENSP00000387480
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRS

SEQ ID NO: 2705 - protein, 741 aa, Homo sapiens; identical to SEQ ID NO: 2702
  Payload ID: 632;
  Gene Symbol: ADARB1;
  Gene Name: adenosine deaminase, RNA-specific, B1;
  Uniprot ID:  P78563;
  ENSP ID: ENSP00000414600

SEQ ID NO: 2706 - protein, 741 aa, Homo sapiens; identical to SEQ ID NO: 2702
  Payload ID: 632;
  Gene Symbol: ADARB1;
  Gene Name: adenosine deaminase, RNA-specific, B1;
  Uniprot ID:  P78563;
  ENSP ID: ENSP00000435381

SEQ ID NO: 2707 - protein, 701 aa, Homo sapiens; identical to SEQ ID NO: 2701
  Payload ID: 632;
  Gene Symbol: ADARB1;
  Gene Name: adenosine deaminase, RNA-specific, B1;
  Uniprot ID:  P78563;
  ENSP ID: ENSP00000436367

SEQ ID NO: 2708 - protein, 52 aa, Homo sapiens
  Payload ID: 632;
  Gene Symbol: ADARB1;
  Gene Name: adenosine deaminase, RNA-specific, B1;
  ENSP ID: ENSP00000478160
MANEHTLIHPASIEDPLEARPMSDEDPEDEDALPARWKKEMGRKRKRTIATL

SEQ ID NO: 2709 - protein, 729 aa, Homo sapiens
  Payload ID: 632;
  Gene Symbol: ADARB1;
  Gene Name: adenosine deaminase, RNA-specific, B1;
  Uniprot ID:  P78563;
  ENSP ID: ENSP00000486475
MKIPRMKTPCQPDRNSLRQSRNPQKYFAMDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 2710 - protein, 141 aa, Homo sapiens
  Payload ID: 633;
  Gene Symbol: ADARB2;
  Gene Name: adenosine deaminase, RNA-specific, B2 (non-functional);
  ENSP ID: ENSP00000370706
MSHRMEGVGQLPASYRHNRPLLSGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 2711 - protein, 248 aa, Homo sapiens
  Payload ID: 633;
  Gene Symbol: ADARB2;
  Gene Name: adenosine deaminase, RNA-specific, B2 (non-functional);
  Uniprot ID:  Q9NS39;
  ENSP ID: ENSP00000370711
MGLWSPVPGNSVPRAPVMAGLGLGHSQGAPQGPHDGKTDRSSGPGRRRTERTRLPGLLGGAPLTAGSPHRWNVLGLQGALLSHFVEPVYLQSIVVGSLHHTGHLARVMSHRMEGVGQLPASYRHNRPLLSGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 2712 - protein, 739 aa, Homo sapiens
  Payload ID: 633;
  Gene Symbol: ADARB2;
  Gene Name: adenosine deaminase, RNA-specific, B2 (non-functional);
  Uniprot ID:  Q9NS39;
  ENSP ID: ENSP00000370713
MASVLGSGRGSGGLSSQLKCKSKRRRRRRSKRKDKVSILSTFLAPFKHLSPGITNTEDDDTLSTSSAEVKENRNVGNLAARPPPSGDRARGGAPGAKRKRPLEEGNGGHLCKLQLVWKKLSWSVAPKNALVQLHELRPGLQYRTVSQTGPVHAPVFAVAVEVNGLTFEGTGPTKKKAKMRAAELALRSFVQFPNACQAHLAMGGGPGPGTDFTSDQADFPDTLFQEFEPPAPRPGLAGGRPGDAALLSAAYGRRRLLCRALDLVGPTPATPAAPGERNPVVLLNRLRAGLRYVCLAEPAERRARSFVMAVSVDGRTFEGSGRSKKLARGQAAQAALQELFDIQMPGHAPGRARRTPMPQEFADSISQLVTQKFREVTTDLTPMHARHKALAGIVMTKGLDARQAQVVALSSGTKCISGEHLSDQGLVVNDCHAEVVARRAFLHFLYTQLELHLSKRREDSERSIFVRLKEGGYRLRENILFHLYVSTSPCGDARLHSPYEITTDLHSSKHLVRKFRGHLRTKIESGEGTVPVRGPSAVQTWDGVLLGEQLITMSCTDKIARWNVLGLQGALLSHFVEPVYLQSIVVGSLHHTGHLARVMSHRMEGVGQLPASYRHNRPLLSGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 2713 - protein, 502 aa, Homo sapiens
  Payload ID: 634;
  Gene Symbol: ADAT1;
  Gene Name: adenosine deaminase, tRNA-specific 1;
  Uniprot ID:  Q9BUB4;
  ENSP ID: ENSP00000310015
MWTADEIAQLCYEHYGIRLPKKGKPEPNHEWTLLAAVVKIQSPADKACDTPDKPVQVTKEVVSMGTGTKCIGQSKMRKNGDILNDSHAEVIARRSFQRYLLHQLQLAATLKEDSIFVPGTQKGVWKLRRDLIFVFFSSHTPCGDASIIPMLEFEDQPCCPVFRNWAHNSSVEASSNLEAPGNERKCEDPDSPVTKKMRLEPGTAAREVTNGAAHHQSFGKQKSGPISPGIHSCDLTVEGLATVTRIAPGSAKVIDVYRTGAKCVPGEAGDSGKPGAAFHQVGLLRVKPGRGDRTRSMSCSDKMARWNVLGCQGALLMHLLEEPIYLSAVVIGKCPYSQEAMQRALIGRCQNVSALPKGFGVQELKILQSDLLFEQSRSAVQAKRADSPGRLVPCGAAISWSAVPEQPLDVTANGFPQGTTKKTIGSLQARSQISKVELFRSFQKLLSRIARDKWPHSLRVQKLDTYQEYKEAASSYQEAWSTLRKQVFGSWIRNPPDYHQFK

SEQ ID NO: 2714 - protein, 18 aa, Homo sapiens
  Payload ID: 634;
  Gene Symbol: ADAT1;
  Gene Name: adenosine deaminase, tRNA-specific 1;
  ENSP ID: ENSP00000455000
QKLLSRIARDKWPHSLSF

SEQ ID NO: 2715 - protein, 160 aa, Homo sapiens
  Payload ID: 634;
  Gene Symbol: ADAT1;
  Gene Name: adenosine deaminase, tRNA-specific 1;
  ENSP ID: ENSP00000455108
MWTADEIAQLCYEHYGIRLPKKGKPEPNHEWTLLAAVVKIQSPADKACDTPDKPVQVTKEVVSMGTGTKCIGQSKMRKNGDILNDSHAEVIARRSFQRYLLHQLQLAATLKEDSIFVPGTQKGVWKLRRDLIFVFFSSHTPCGDASIIPMLEFEDQPCCP

SEQ ID NO: 2716 - protein, 120 aa, Homo sapiens
  Payload ID: 634;
  Gene Symbol: ADAT1;
  Gene Name: adenosine deaminase, tRNA-specific 1;
  ENSP ID: ENSP00000455121
FGVQELKILQSDLLFEQSRSAVQAKRADSPGRLVPCGAAISWSAVPEQPLDVTANGFPQGTTKKTIGSLQARSQISKVELFRSFQKLLSRIARDKWPHSLRRPRWADHDVRRSRPSWPTW

SEQ ID NO: 2717 - protein, 10 aa, Homo sapiens
  Payload ID: 634;
  Gene Symbol: ADAT1;
  Gene Name: adenosine deaminase, tRNA-specific 1;
  ENSP ID: ENSP00000456751
MWTADEIAQL

SEQ ID NO: 2718 - protein, 103 aa, Homo sapiens
  Payload ID: 634;
  Gene Symbol: ADAT1;
  Gene Name: adenosine deaminase, tRNA-specific 1;
  ENSP ID: ENSP00000456768
MWTADEIAQLCYEHYGIRLPKKGKPEPNHEWTLLAAVVKIQSPADKACDTPDKPVQVTKEVVSMGTGTKCIGQSKMRKNGTRPSPASICLHLVSYLCRRRHPQ

SEQ ID NO: 2719 - protein, 109 aa, Homo sapiens
  Payload ID: 634;
  Gene Symbol: ADAT1;
  Gene Name: adenosine deaminase, tRNA-specific 1;
  ENSP ID: ENSP00000457501
MWTADEIAQLCYEHYGIRLPKKGKPEPNHEWTLLAAVVKIQSPADKACDTPDKPVQVTKEVVSMGTGTKCIGQSKMRKNGDILNDSHAEVIARRSFQRYLLHQLQLAAT

SEQ ID NO: 2720 - protein, 91 aa, Homo sapiens
  Payload ID: 634;
  Gene Symbol: ADAT1;
  Gene Name: adenosine deaminase, tRNA-specific 1;
  ENSP ID: ENSP00000457999
MWTADEIAQLCYEHYGIRLPKKGKPEPNHEWTLLAAVVKIQSPADKACDTPDKPVQVTKEVVSMGTGTKCIGQSKMRKNGTFSTNSSWQPP

SEQ ID NO: 2721 - protein, 191 aa, Homo sapiens
  Payload ID: 635;
  Gene Symbol: ADAT2;
  Gene Name: adenosine deaminase, tRNA-specific 2;
  Uniprot ID:  Q7Z6V5;
  ENSP ID: ENSP00000237283
MEAKAAPKPAASGACSVSAEETEKWMEEAMHMAKEALENTEVPVGCLMVYNNEVVGKGRNEVNQTKNATRHAEMVAIDQVLDWCRQSGKSPSEVFEHTVLYVTVEPCIMCAAALRLMKIPLVVYGCQNERFGGCGSVLNIASADLPNTGRPFQCIPGYRAEEAVEMLKTFYKQENPNAPKSKVRKKECQKS

SEQ ID NO: 2722 - protein, 144 aa, Homo sapiens
  Payload ID: 635;
  Gene Symbol: ADAT2;
  Gene Name: adenosine deaminase, tRNA-specific 2;
  Uniprot ID:  Q7Z6V5;
  ENSP ID: ENSP00000475651
MVYNNEVVGKGRNEVNQTKNATRHAEMVAIDQVLDWCRQSGKSPSEVFEHTVLYVTVEPCIMCAAALRLMKIPLVVYGCQNERFGGCGSVLNIASADLPNTGRPFQCIPGYRAEEAVEMLKTFYKQENPNAPKSKVRKKECQKS

SEQ ID NO: 2723 - protein, 367 aa, Homo sapiens
  Payload ID: 636;
  Gene Symbol: ADAT3;
  Gene Name: adenosine deaminase, tRNA-specific 3;
  ENSP ID: ENSP00000332448
MILCSRLCLPQSASLRMEPAPGLVEQPKCLEAGSPEPEPAPWQALPVLSEKQSGDVELVLAYAAPVLDKRQTSRLLKEVSALHPLPAQPHLKRVRPSRDAGSPHALEMLLCLAGPASGPRSLAELLPRPAVDPRGLGQPFLVPVPARPPLTRGQFEEARAHWPTSFHEDKQVTSALAGRLFSTQERAAMQSHMERAVWAARRAAARGLRAVGAVVVDPASDRVLATGHDCSCADNPLLHAVMVCVDLVARGQGRGTYDFRPFPACSFAPAAAPQAVRAGAVRKLDADEDGLPYLCTGYDLYVTREPCAMCAMALVHARILRVFYGAPSPDGALGTRFRIHARPDLNHRFQVFRGVLEEQCRWLDPDT

SEQ ID NO: 2724 - protein, 69 aa, Homo sapiens
  Payload ID: 636;
  Gene Symbol: ADAT3;
  Gene Name: adenosine deaminase, tRNA-specific 3;
  ENSP ID: ENSP00000404502
MILCSRLCLPQSASLRMEPAPGLVEQPKCLEAGSPEPEPAPWQALPVLSEKQSGDVELVLAYAAPVLDK

SEQ ID NO: 2725 - protein, 267 aa, Homo sapiens
  Payload ID: 637;
  Gene Symbol: ADAL;
  Gene Name: adenosine deaminase-like;
  Uniprot ID:  Q6DHV7;
  ENSP ID: ENSP00000374302
MIEAEEQQPCKTDFYSELPKVELHAHLNGSISSHTMKKLIAQKPDLKIHDQMTVIDKGKKRTLEECFQMFQTIHQLTSSPEDILMVTKDVIKEFADDGVKYLELRSTPRRENATGMTKKTYVESILEGIKQSKQENLDIDVRYLIAVDRRGGPLVAKETVKLAEEFFLSTEGTVLGLDLSGDPTVGQAKDFLEPLLEAKKAGLKLALHLSEIPNQKKETQILLDLLPDRIGHGTFLNSGEGGSLDLVDFVRQHRIPLGKAWSFRSSR

SEQ ID NO: 2726 - protein, 328 aa, Homo sapiens
  Payload ID: 637;
  Gene Symbol: ADAL;
  Gene Name: adenosine deaminase-like;
  Uniprot ID:  Q6DHV7;
  ENSP ID: ENSP00000398744
MIEAEEQQPCKTDFYSELPKVELHAHLNGSISSHTMKKLIAQKPDLKIHDQMTVIDKGKKRTLEECFQMFQTIHQLTSSPEDILMVTKDVIKEFADDGVKYLELRSTPRRENATGMTKKTYVESILEGIKQSKQENLDIDVRYLIAVDRRGGPLVAKETVKLAEEFFLSTEGTVLGLDLSGDPTIPNQKKETQILLDLLPDRIGHGTFLNSGEGGSLDLVDFVRQHRIPLELCLTSNVKSQTVPSYDQHHFGFWYSIAHPSVICTDDKGVFATHLSQEYQLAAETFNLTQSQVWDLSYESINYIFASDSTRSELRKKWNHLKPRVLHI

SEQ ID NO: 2727 - protein, 328 aa, Homo sapiens; identical to SEQ ID NO: 2726
  Payload ID: 637;
  Gene Symbol: ADAL;
  Gene Name: adenosine deaminase-like;
  Uniprot ID:  Q6DHV7;
  ENSP ID: ENSP00000413074

SEQ ID NO: 2728 - protein, 35 aa, Homo sapiens
  Payload ID: 637;
  Gene Symbol: ADAL;
  Gene Name: adenosine deaminase-like;
  ENSP ID: ENSP00000455907
MKKLIAQKPDLKIHDQMTVIDKGKKRTLEESQKMS

SEQ ID NO: 2729 - protein, 355 aa, Homo sapiens
  Payload ID: 637;
  Gene Symbol: ADAL;
  Gene Name: adenosine deaminase-like;
  Uniprot ID:  Q6DHV7;
  ENSP ID: ENSP00000456242
MIEAEEQQPCKTDFYSELPKVELHAHLNGSISSHTMKKLIAQKPDLKIHDQMTVIDKGKKRTLEECFQMFQTIHQLTSSPEDILMVTKDVIKEFADDGVKYLELRSTPRRENATGMTKKTYVESILEGIKQSKQENLDIDVRYLIAVDRRGGPLVAKETVKLAEEFFLSTEGTVLGLDLSGDPTVGQAKDFLEPLLEAKKAGLKLALHLSEIPNQKKETQILLDLLPDRIGHGTFLNSGEGGSLDLVDFVRQHRIPLELCLTSNVKSQTVPSYDQHHFGFWYSIAHPSVICTDDKGVFATHLSQEYQLAAETFNLTQSQVWDLSYESINYIFASDSTRSELRKKWNHLKPRVLHI

SEQ ID NO: 2730 - protein, 110 aa, Homo sapiens
  Payload ID: 637;
  Gene Symbol: ADAL;
  Gene Name: adenosine deaminase-like;
  ENSP ID: ENSP00000457591
  MOD_RES (1)..(1): Any amino acid
XKLAEEFFLSTEGTVLGLDLSGDPTIPNQKKETQILLDLLPDRIGHGTFLNSGEGGSLDLVDFVRQHRIPLELCLTSNVKSQTVPSYDQHHFGFWYSIAHPSVICVRCSV

SEQ ID NO: 2731 - protein, 267 aa, Homo sapiens; identical to SEQ ID NO: 2725
  Payload ID: 637;
  Gene Symbol: ADAL;
  Gene Name: adenosine deaminase-like;
  Uniprot ID:  Q6DHV7;
  ENSP ID: ENSP00000478575

SEQ ID NO: 2732 - protein, 362 aa, Homo sapiens
  Payload ID: 638;
  Gene Symbol: ADK;
  Gene Name: adenosine kinase;
  Uniprot ID:  P55263;
  ENSP ID: ENSP00000286621
MAAAEEEPKPKKLKVEAPQALRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 2733 - protein, 345 aa, Homo sapiens
  Payload ID: 638;
  Gene Symbol: ADK;
  Gene Name: adenosine kinase;
  Uniprot ID:  P55263;
  ENSP ID: ENSP00000361819
MTSVRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 2734 - protein, 327 aa, Homo sapiens
  Payload ID: 638;
  Gene Symbol: ADK;
  Gene Name: adenosine kinase;
  Uniprot ID:  P55263;
  ENSP ID: ENSP00000438321
MTSVRENILFGMGNPLLDISAVVDKDFLDKFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 2735 - protein, 305 aa, Homo sapiens
  Payload ID: 638;
  Gene Symbol: ADK;
  Gene Name: adenosine kinase;
  Uniprot ID:  P55263;
  ENSP ID: ENSP00000443965
MAAAEEEPKPKKLKVEAPQALRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 2736 - protein, 776 aa, Homo sapiens
  Payload ID: 639;
  Gene Symbol: AMPD1;
  Gene Name: adenosine monophosphate deaminase 1;
  Uniprot ID:  P23109;
  ENSP ID: ENSP00000358551
MNVRIFYSVSQSPHSLLSLLFYCAILESRISATMPLFKLPEIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVFTPPVKKGEDPFRTDNLPENLGYHLKMKDGVVYVYPNEAAVSKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEEKVKFLGDNYLEEGPAGNDIRRTNVAQIRMAYRYETWCYELNLIAEGLKSTE

SEQ ID NO: 2737 - protein, 780 aa, Homo sapiens
  Payload ID: 639;
  Gene Symbol: AMPD1;
  Gene Name: adenosine monophosphate deaminase 1;
  Uniprot ID:  P23109;
  ENSP ID: ENSP00000430075
MNVRIFYSVSQSPHSLLSLLFYCAILESRISATMPLFKLPAEEKQIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVFTPPVKKGEDPFRTDNLPENLGYHLKMKDGVVYVYPNEAAVSKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEEKVKFLGDNYLEEGPAGNDIRRTNVAQIRMAYRYETWCYELNLIAEGLKSTE

SEQ ID NO: 2738 - protein, 879 aa, Homo sapiens
  Payload ID: 640;
  Gene Symbol: AMPD2;
  Gene Name: adenosine monophosphate deaminase 2;
  Uniprot ID:  Q01433;
  ENSP ID: ENSP00000256578
MRNRGQGLFRLRSRCFLHQSLPLGAGRRKGLDVAEPGPSRCRSDSPAVAAVVPAMASYPSGSGKPKAKYPFKKRASLQASTAAPEARGGLGAPPLQSARSLPGPAPCLKHFPLDLRTSMDGKCKEIAEELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 2739 - protein, 798 aa, Homo sapiens
  Payload ID: 640;
  Gene Symbol: AMPD2;
  Gene Name: adenosine monophosphate deaminase 2;
  Uniprot ID:  Q01433;
  ENSP ID: ENSP00000345498
MASEARGGLGAPPLQSARSLPGPAPCLKHFPLDLRTSMDGKCKEIAEELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 2740 - protein, 804 aa, Homo sapiens
  Payload ID: 640;
  Gene Symbol: AMPD2;
  Gene Name: adenosine monophosphate deaminase 2;
  Uniprot ID:  Q01433;
  ENSP ID: ENSP00000351573
MWQSQAPAGAAQTPPLSPPWSQPWHPIHLALASPRPNIPLRSGPACRPPLQLQELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 2741 - protein, 861 aa, Homo sapiens
  Payload ID: 640;
  Gene Symbol: AMPD2;
  Gene Name: adenosine monophosphate deaminase 2;
  ENSP ID: ENSP00000358855
  MOD_RES (1)..(1): Any amino acid
XLDVAEPGPSRCRSDSPAVAAVVPAMASYPSGSGKPKAKYPFKKRASLQASTAAPEARGGLGAPPLQSARSLPGPAPCLKHFPLDLRTSMDGKCKEIAEELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKVRAQQAARRAGEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 2742 - protein, 760 aa, Homo sapiens
  Payload ID: 640;
  Gene Symbol: AMPD2;
  Gene Name: adenosine monophosphate deaminase 2;
  Uniprot ID:  Q01433;
  ENSP ID: ENSP00000377292
MLTFLPSPQELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 2743 - protein, 195 aa, Homo sapiens
  Payload ID: 640;
  Gene Symbol: AMPD2;
  Gene Name: adenosine monophosphate deaminase 2;
  ENSP ID: ENSP00000431904
ECVLPGLRIDAGLCLATSRPRCWSPQRGPPPPASSLWWCPSTSVPGTAGLEEARGGLGAPPLQSARSLPGPAPCLKHFPLDLRTSMDGKCKEIAEELFTRSLAESELRSAPYEFPEESPIEQLEERRQRLERQISQDVKLEPDILLRAKQDFLKTDSDSDLQLYKEQGEGQGDRSLRERDVLEREFQRVTISGEE

SEQ ID NO: 2744 - protein, 87 aa, Homo sapiens
  Payload ID: 640;
  Gene Symbol: AMPD2;
  Gene Name: adenosine monophosphate deaminase 2;
  ENSP ID: ENSP00000431975
MDGKCKEIAEELFTRSLAESELRSAPYEFPEESPIEQLEERRQRLERQISQDVKLEPDILLRAKQDFLKTDSDSDLQLYKEQGEGQG

SEQ ID NO: 2745 - protein, 1 aa, Homo sapiens
  Payload ID: 640;
  Gene Symbol: AMPD2;
  Gene Name: adenosine monophosphate deaminase 2;
  ENSP ID: ENSP00000432344
M

SEQ ID NO: 2746 - protein, 103 aa, Homo sapiens
  Payload ID: 640;
  Gene Symbol: AMPD2;
  Gene Name: adenosine monophosphate deaminase 2;
  ENSP ID: ENSP00000433739
MASEARGGLGAPPLQSARSLPGPAPCLKHFPLDLRTSMDGKCKEIAEELFTRSLAESELRSAPYEFPEESPIEQLEERRQRLERQISQDVKLEPDILLRAKQD

SEQ ID NO: 2747 - protein, 83 aa, Homo sapiens
  Payload ID: 640;
  Gene Symbol: AMPD2;
  Gene Name: adenosine monophosphate deaminase 2;
  ENSP ID: ENSP00000434891
AVAAVVPAMASYPSGSGKPKAKYPFKKRASLQASTAAPDDWCKVSTVLRVFSVPRSVPSRKGVPWVGPFLALFGSAIGQLIRI

SEQ ID NO: 2748 - protein, 1 aa, Homo sapiens
  Payload ID: 640;
  Gene Symbol: AMPD2;
  Gene Name: adenosine monophosphate deaminase 2;
  ENSP ID: ENSP00000436303
M

SEQ ID NO: 2749 - protein, 879 aa, Homo sapiens; identical to SEQ ID NO: 2738
  Payload ID: 640;
  Gene Symbol: AMPD2;
  Gene Name: adenosine monophosphate deaminase 2;
  Uniprot ID:  Q01433;
  ENSP ID: ENSP00000436541

SEQ ID NO: 2750 - protein, 231 aa, Homo sapiens
  Payload ID: 640;
  Gene Symbol: AMPD2;
  Gene Name: adenosine monophosphate deaminase 2;
  ENSP ID: ENSP00000437025
  MOD_RES (1)..(1): Any amino acid
XELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKVKSHWLGPNYTKEGPEGNDIRRTNVPDIRVGYRYETLCQELALITQAVQSEMLETIPEEAGITMSPGPQ

SEQ ID NO: 2751 - protein, 761 aa, Homo sapiens
  Payload ID: 640;
  Gene Symbol: AMPD2;
  Gene Name: adenosine monophosphate deaminase 2;
  Uniprot ID:  Q01433;
  ENSP ID: ENSP00000437164
MDGKCKEIAEELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 2752 - protein, 767 aa, Homo sapiens
  Payload ID: 641;
  Gene Symbol: AMPD3;
  Gene Name: adenosine monophosphate deaminase 3;
  Uniprot ID:  Q01432;
  ENSP ID: ENSP00000379801
MPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 2753 - protein, 776 aa, Homo sapiens
  Payload ID: 641;
  Gene Symbol: AMPD3;
  Gene Name: adenosine monophosphate deaminase 3;
  Uniprot ID:  Q01432;
  ENSP ID: ENSP00000379802
MALSSEPAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 2754 - protein, 608 aa, Homo sapiens
  Payload ID: 641;
  Gene Symbol: AMPD3;
  Gene Name: adenosine monophosphate deaminase 3;
  Uniprot ID:  Q01432;
  ENSP ID: ENSP00000396000
MIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 2755 - protein, 767 aa, Homo sapiens; identical to SEQ ID NO: 2752
  Payload ID: 641;
  Gene Symbol: AMPD3;
  Gene Name: adenosine monophosphate deaminase 3;
  Uniprot ID:  Q01432;
  ENSP ID: ENSP00000431648

SEQ ID NO: 2756 - protein, 111 aa, Homo sapiens
  Payload ID: 641;
  Gene Symbol: AMPD3;
  Gene Name: adenosine monophosphate deaminase 3;
  ENSP ID: ENSP00000432707
MPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTP

SEQ ID NO: 2757 - protein, 267 aa, Homo sapiens
  Payload ID: 641;
  Gene Symbol: AMPD3;
  Gene Name: adenosine monophosphate deaminase 3;
  ENSP ID: ENSP00000433284
MPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITD

SEQ ID NO: 2758 - protein, 110 aa, Homo sapiens
  Payload ID: 641;
  Gene Symbol: AMPD3;
  Gene Name: adenosine monophosphate deaminase 3;
  ENSP ID: ENSP00000433351
AAACMNQKHLLRFIKHTYQTEPDRTVAEKRGRKITLRQVFDGLHMDPYDLTVDSLDVHAVSELLLQCRQQTAALAGDSAPWKATMIVLAGRCYGSSFLFYLTERSCGLRE

SEQ ID NO: 2759 - protein, 212 aa, Homo sapiens
  Payload ID: 641;
  Gene Symbol: AMPD3;
  Gene Name: adenosine monophosphate deaminase 3;
  ENSP ID: ENSP00000433937
MALSSEPAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPGGHPLCV

SEQ ID NO: 2760 - protein, 90 aa, Homo sapiens
  Payload ID: 641;
  Gene Symbol: AMPD3;
  Gene Name: adenosine monophosphate deaminase 3;
  ENSP ID: ENSP00000434608
PPYSYYLYYMYANIMVLNNLRRERGLSTFLFRPHCGEAGSITHLVSAFLTADNISHGLLLKKQQQFVPRIFQEPSEGIPTQGTACFSFHR

SEQ ID NO: 2761 - protein, 677 aa, Homo sapiens
  Payload ID: 641;
  Gene Symbol: AMPD3;
  Gene Name: adenosine monophosphate deaminase 3;
  ENSP ID: ENSP00000435382
MPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKLKCGS

SEQ ID NO: 2762 - protein, 774 aa, Homo sapiens
  Payload ID: 641;
  Gene Symbol: AMPD3;
  Gene Name: adenosine monophosphate deaminase 3;
  Uniprot ID:  Q01432;
  ENSP ID: ENSP00000436987
MEPGSAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 2763 - protein, 432 aa, Homo sapiens
  Payload ID: 642;
  Gene Symbol: AHCY;
  Gene Name: adenosylhomocysteinase;
  Uniprot ID:  P23526;
  ENSP ID: ENSP00000217426
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 2764 - protein, 404 aa, Homo sapiens
  Payload ID: 642;
  Gene Symbol: AHCY;
  Gene Name: adenosylhomocysteinase;
  Uniprot ID:  P23526;
  ENSP ID: ENSP00000442820
MPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 2765 - protein, 483 aa, Homo sapiens
  Payload ID: 643;
  Gene Symbol: AHCYL1;
  Gene Name: adenosylhomocysteinase-like 1;
  Uniprot ID:  O43865;
  ENSP ID: ENSP00000352092
MQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 2766 - protein, 530 aa, Homo sapiens
  Payload ID: 643;
  Gene Symbol: AHCYL1;
  Gene Name: adenosylhomocysteinase-like 1;
  Uniprot ID:  O43865;
  ENSP ID: ENSP00000358814
MSMPDAMPLPGVGEELKQAKEIEDAEKYSFMATVTKAPKKQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 2767 - protein, 483 aa, Homo sapiens; identical to SEQ ID NO: 2765
  Payload ID: 643;
  Gene Symbol: AHCYL1;
  Gene Name: adenosylhomocysteinase-like 1;
  Uniprot ID:  O43865;
  ENSP ID: ENSP00000377238

SEQ ID NO: 2768 - protein, 611 aa, Homo sapiens
  Payload ID: 644;
  Gene Symbol: AHCYL2;
  Gene Name: adenosylhomocysteinase-like 2;
  Uniprot ID:  Q96HN2;
  ENSP ID: ENSP00000315931
MSVQVVSAAAAAKVPEVELKDLSPSEAESQLGLSTAAVGAMAPPAGGGDPEAPAPAAERPPVPGPGSGPAAALSPAAGKVPQASAMKRSDPHHQHQRHRDGGEALVSPDGTVTEAPRTVKKQIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 2769 - protein, 610 aa, Homo sapiens
  Payload ID: 644;
  Gene Symbol: AHCYL2;
  Gene Name: adenosylhomocysteinase-like 2;
  Uniprot ID:  Q96HN2;
  ENSP ID: ENSP00000413639
MSVQVVSAAAAAKVPEVELKDLSPSEAESQLGLSTAAVGAMAPPAGGGDPEAPAPAAERPPVPGPGSGPAAALSPAAGKVPQASAMKRSDPHHQHQRHRDGGEALVSPDGTVTEAPRTVKKIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 2770 - protein, 518 aa, Homo sapiens
  Payload ID: 644;
  Gene Symbol: AHCYL2;
  Gene Name: adenosylhomocysteinase-like 2;
  ENSP ID: ENSP00000419346
  MOD_RES (1)..(1): Any amino acid
XRKWSRQFLLSFWCTVCSAHQGTIFLSLKIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 2771 - protein, 182 aa, Homo sapiens
  Payload ID: 644;
  Gene Symbol: AHCYL2;
  Gene Name: adenosylhomocysteinase-like 2;
  ENSP ID: ENSP00000419608
MLGSKKKYIVNGNSGIKAQQIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGE

SEQ ID NO: 2772 - protein, 75 aa, Homo sapiens
  Payload ID: 644;
  Gene Symbol: AHCYL2;
  Gene Name: adenosylhomocysteinase-like 2;
  ENSP ID: ENSP00000419717
MEKWDGNEGTSAFHMPEWMQIQFADQKQEFNKRPTKIGRRSLSRSISQSSTDSYSSAASYTDSSDDETSPRDKQQ

SEQ ID NO: 2773 - protein, 508 aa, Homo sapiens
  Payload ID: 644;
  Gene Symbol: AHCYL2;
  Gene Name: adenosylhomocysteinase-like 2;
  Uniprot ID:  Q96HN2;
  ENSP ID: ENSP00000420459
MEKWDGNEGTSAFHMPEWMIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 2774 - protein, 508 aa, Homo sapiens
  Payload ID: 644;
  Gene Symbol: AHCYL2;
  Gene Name: adenosylhomocysteinase-like 2;
  Uniprot ID:  Q96HN2;
  ENSP ID: ENSP00000420801
MLGSKKKYIVNGNSGIKAQIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 2775 - protein, 265 aa, Homo sapiens
  Payload ID: 645;
  Gene Symbol: AMD1;
  Gene Name: adenosylmethionine decarboxylase 1;
  ENSP ID: ENSP00000357870
MFVSKRRFILKTCGTTLLLKALVPLLKLARDYSGFDSIQSFFYSRKNFMKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 2776 - protein, 265 aa, Homo sapiens; identical to SEQ ID NO: 2775
  Payload ID: 645;
  Gene Symbol: AMD1;
  Gene Name: adenosylmethionine decarboxylase 1;
  ENSP ID: ENSP00000357871

SEQ ID NO: 2777 - protein, 214 aa, Homo sapiens
  Payload ID: 645;
  Gene Symbol: AMD1;
  Gene Name: adenosylmethionine decarboxylase 1;
  ENSP ID: ENSP00000357877
MEAAHFFEGTEKLLEVWFSRQQPDANQGSGDLRTIPRYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 2778 - protein, 334 aa, Homo sapiens
  Payload ID: 645;
  Gene Symbol: AMD1;
  Gene Name: adenosylmethionine decarboxylase 1;
  Uniprot ID:  P17707;
  ENSP ID: ENSP00000357880
MEAAHFFEGTEKLLEVWFSRQQPDANQGSGDLRTIPRSEWDILLKDVQCSIISVTKTDKQEAYVLSESSMFVSKRRFILKTCGTTLLLKALVPLLKLARDYSGFDSIQSFFYSRKNFMKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 2779 - protein, 48 aa, Homo sapiens
  Payload ID: 645;
  Gene Symbol: AMD1;
  Gene Name: adenosylmethionine decarboxylase 1;
  ENSP ID: ENSP00000389988
MEAAHFFEGTEKLLEVWFSRQQPDANQGSGDLRTIPRWSSILYGTYEF

SEQ ID NO: 2780 - protein, 5 aa, Homo sapiens
  Payload ID: 645;
  Gene Symbol: AMD1;
  Gene Name: adenosylmethionine decarboxylase 1;
  ENSP ID: ENSP00000433396
DSFHS

SEQ ID NO: 2781 - protein, 265 aa, Homo sapiens; identical to SEQ ID NO: 2775
  Payload ID: 645;
  Gene Symbol: AMD1;
  Gene Name: adenosylmethionine decarboxylase 1;
  ENSP ID: ENSP00000483984

SEQ ID NO: 2782 - protein, 1119 aa, Homo sapiens
  Payload ID: 646;
  Gene Symbol: ADCY1;
  Gene Name: adenylate cyclase 1 (brain);
  Uniprot ID:  Q08828;
  ENSP ID: ENSP00000297323
MAGAPRGGGGGGGGAGEPGGAERAAGTSRRRGLRACDEEFACPELEALFRGYTLRLEQAATLKALAVLSLLAGALALAELLGAPGPAPGLAKGSHPVHCVLFLALLVVTNVRSLQVPQLQQVGQLALLFSLTFALLCCPFALGGPARGSAGAAGGPATAEQGVWQLLLVTFVSYALLPVRSLLAIGFGLVVAASHLLVTATLVPAKRPRLWRTLGANALLFVGVNMYGVFVRILTERSQRKAFLQARSCIEDRLRLEDENEKQERLLMSLLPRNVAMEMKEDFLKPPERIFHKIYIQRHDNVSILFADIVGFTGLASQCTAQELVKLLNELFGKFDELATENHCRRIKILGDCYYCVSGLTQPKTDHAHCCVEMGLDMIDTITSVAEATEVDLNMRVGLHTGRVLCGVLGLRKWQYDVWSNDVTLANVMEAAGLPGKVHITKTTLACLNGDYEVEPGYGHERNSFLKTHNIETFFIVPSHRRKIFPGLILSDIKPAKRMKFKTVCYLLVQLMHCRKMFKAEIPFSNVMTCEDDDKRRALRTASEKLRNRSSFSTNVVYTTPGTRVNRYISRLLEARQTELEMADLNFFTLKYKHVEREQKYHQLQDEYFTSAVVLTLILAALFGLVYLLIFPQSVVVLLLLVFCICFLVACVLYLHITRVQCFPGCLTIQIRTVLCIFIVVLIYSVAQGCVVGCLPWAWSSKPNSSLVVLSSGGQRTALPTLPCESTHHALLCCLVGTLPLAIFFRVSSLPKMILLSGLTTSYILVLELSGYTRTGGGAVSGRSYEPIVAILLFSCALALHARQVDIRLRLDYLWAAQAEEEREDMEKVKLDNRRILFNLLPAHVAQHFLMSNPRNMDLYYQSYSQVGVMFASIPNFNDFYIELDGNNMGVECLRLLNEIIADFDELMEKDFYKDIEKIKTIGSTYMAAVGLAPTSGTKAKKSISSHLSTLADFAIEMFDVLDEINYQSYNDFVLRVGINVGPVVAGVIGARRPQYDIWGNTVNVASRMDSTGVQGRIQVTEEVHRLLRRCPYHFVCRGKVSVKGKGEMLTYFLEGRTDGNGSQIRSLGLDRKMCPFGRAGLQGRRPPVCPMPGVSVRAGLPPHSPGQYLPSAAAGKEA

SEQ ID NO: 2783 - protein, 338 aa, Homo sapiens
  Payload ID: 646;
  Gene Symbol: ADCY1;
  Gene Name: adenylate cyclase 1 (brain);
  ENSP ID: ENSP00000392721
MYGVFVRILTERSQRKAFLQARSCIEDRLRLEDENEKQERLLMSLLPRNVAMEMKEDFLKPPERIFHKIYIQRHDNVSILFADIVGFTGLASQCTAQELVKLLNELFGKFDELATENHCRRIKILGDCYYCVSGLTQPKTDHAHCCVEMGLDMIDTITSVAEATEVDLNMRVGLHTGRVLCGVLGLRKWQYDVWSNDVTLANVMEAAGLPGKVHITKTTLACLNGDYEVEPGYGHERNSFLKTHNIETFFIVPSHRRKIFPGLILSDIKPAKRMKFKTVCYLLVQLMHCRKMFKAEIPFSNVMTCEDDDKVQIHPSLSGLDVLLGFWSPTLQRGRLCT

SEQ ID NO: 2784 - protein, 338 aa, Homo sapiens; identical to SEQ ID NO: 2783
  Payload ID: 646;
  Gene Symbol: ADCY1;
  Gene Name: adenylate cyclase 1 (brain);
  ENSP ID: ENSP00000479770

SEQ ID NO: 2785 - protein, 1518 aa, Homo sapiens
  Payload ID: 647;
  Gene Symbol: ADCY10;
  Gene Name: adenylate cyclase 10 (soluble);
  Uniprot ID:  Q96PN6;
  ENSP ID: ENSP00000356822
MSLSEGDALLALWRVERKQLKNIITVVIKCSLEIHGLFETQEWEEGLDIRVKIGLAAGHISMLVFGDETHSHFLVIGQAVDDVRLAQNMAQMNDVILSPNCWQLCDRSMIEIESVPDQRAVKVNFLKPPPNFNFDEFFTKCTTFMHYYPSGEHKNLLRLACTLKPDPELEMSLQKYVMESILKQIDNKQLQGYLSELRPVTIVFVNLMFEDQDKAEEIGPAIQDAYMHITSVLKIFQGQINKVFMFDKGCSFLCVFGFPGEKVPDELTHALECAMDIFDFCSQVHKIQTVSIGVASGIVFCGIVGHTVRHEYTVIGQKVNLAARMMMYYPGIVTCDSVTYNGSNLPAYFFKELPKKVMKGVADSGPLYQYWGRTEKVMFGMACLICNRKEDYPLLGRNKEINYFMYTMKKFLISNSSQVLMYEGLPGYGKSQILMKIEYLAQGKNHRIIAISLNKISFHQTFYTIQMFMANVLGLDTCKHYKERQTNLRNKVMTLLDEKFYCLLNDIFHVQFPISREISRMSTLKKQKQLEILFMKILKLIVKEERIIFIIDEAQFVDSTSWRFMEKLIRTLPIFIIMSLCPFVNIPCAAARAVIKNRNTTYIVIGAVQPNDISNKICLDLNVSCISKELDSYLGEGSCGIPFYCEELLKNLEHHEVLVFQQTESEEKTNRTWNNLFKYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKTEEKLILSNSEIPETSAFFPENRSPEEIREKILNFFDHVLTKMKTSDEDIIPLESCQCEEILEIVILPLAHHFLALGENDKALYYFLEIASAYLIFCDNYMAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWYARLQEWDNFYKFSNRAKNLLPRRTMTLTYYDGISRYMEGQVLHLQKQIKEQSENAQASGEELLKNLENLVAQNTTGPVFCPRLYHLMAYVCILMGDGQKCGLFLNTALRLSETQGNILEKCWLNMNKESWYSTSELKEDQWLQTILSLPSWEKIVAGRVNIQDLQKNKFLMRANTVDNHF

SEQ ID NO: 2786 - protein, 1610 aa, Homo sapiens
  Payload ID: 647;
  Gene Symbol: ADCY10;
  Gene Name: adenylate cyclase 10 (soluble);
  Uniprot ID:  Q96PN6;
  ENSP ID: ENSP00000356825
MNTPKEEFQDWPIVRIAAHLPDLIVYGHFSPERPFMDYFDGVLMFVDISGFTAMTEKFSSAMYMDRGAEQLVEILNYHISAIVEKVLIFGGDILKFAGDALLALWRVERKQLKNIITVVIKCSLEIHGLFETQEWEEGLDIRVKIGLAAGHISMLVFGDETHSHFLVIGQAVDDVRLAQNMAQMNDVILSPNCWQLCDRSMIEIESVPDQRAVKVNFLKPPPNFNFDEFFTKCTTFMHYYPSGEHKNLLRLACTLKPDPELEMSLQKYVMESILKQIDNKQLQGYLSELRPVTIVFVNLMFEDQDKAEEIGPAIQDAYMHITSVLKIFQGQINKVFMFDKGCSFLCVFGFPGEKVPDELTHALECAMDIFDFCSQVHKIQTVSIGVASGIVFCGIVGHTVRHEYTVIGQKVNLAARMMMYYPGIVTCDSVTYNGSNLPAYFFKELPKKVMKGVADSGPLYQYWGRTEKVMFGMACLICNRKEDYPLLGRNKEINYFMYTMKKFLISNSSQVLMYEGLPGYGKSQILMKIEYLAQGKNHRIIAISLNKISFHQTFYTIQMFMANVLGLDTCKHYKERQTNLRNKVMTLLDEKFYCLLNDIFHVQFPISREISRMSTLKKQKQLEILFMKILKLIVKEERIIFIIDEAQFVDSTSWRFMEKLIRTLPIFIIMSLCPFVNIPCAAARAVIKNRNTTYIVIGAVQPNDISNKICLDLNVSCISKELDSYLGEGSCGIPFYCEELLKNLEHHEVLVFQQTESEEKTNRTWNNLFKYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKTEEKLILSNSEIPETSAFFPENRSPEEIREKILNFFDHVLTKMKTSDEDIIPLESCQCEEILEIVILPLAHHFLALGENDKALYYFLEIASAYLIFCDNYMAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWYARLQEWDNFYKFSNRAKNLLPRRTMTLTYYDGISRYMEGQVLHLQKQIKEQSENAQASGEELLKNLENLVAQNTTGPVFCPRLYHLMAYVCILMGDGQKCGLFLNTALRLSETQGNILEKCWLNMNKESWYSTSELKEDQWLQTILSLPSWEKIVAGRVNIQDLQKNKFLMRANTVDNHF

SEQ ID NO: 2787 - protein, 1457 aa, Homo sapiens
  Payload ID: 647;
  Gene Symbol: ADCY10;
  Gene Name: adenylate cyclase 10 (soluble);
  Uniprot ID:  Q96PN6;
  ENSP ID: ENSP00000441992
MLVFGDETHSHFLVIGQAVDDVRLAQNMAQMNDVILSPNCWQLCDRSMIEIESVPDQRAVKVNFLKPPPNFNFDEFFTKCTTFMHYYPSGEHKNLLRLACTLKPDPELEMSLQKYVMESILKQIDNKQLQGYLSELRPVTIVFVNLMFEDQDKAEEIGPAIQDAYMHITSVLKIFQGQINKVFMFDKGCSFLCVFGFPGEKVPDELTHALECAMDIFDFCSQVHKIQTVSIGVASGIVFCGIVGHTVRHEYTVIGQKVNLAARMMMYYPGIVTCDSVTYNGSNLPAYFFKELPKKVMKGVADSGPLYQYWGRTEKVMFGMACLICNRKEDYPLLGRNKEINYFMYTMKKFLISNSSQVLMYEGLPGYGKSQILMKIEYLAQGKNHRIIAISLNKISFHQTFYTIQMFMANVLGLDTCKHYKERQTNLRNKVMTLLDEKFYCLLNDIFHVQFPISREISRMSTLKKQKQLEILFMKILKLIVKEERIIFIIDEAQFVDSTSWRFMEKLIRTLPIFIIMSLCPFVNIPCAAARAVIKNRNTTYIVIGAVQPNDISNKICLDLNVSCISKELDSYLGEGSCGIPFYCEELLKNLEHHEVLVFQQTESEEKTNRTWNNLFKYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKTEEKLILSNSEIPETSAFFPENRSPEEIREKILNFFDHVLTKMKTSDEDIIPLESCQCEEILEIVILPLAHHFLALGENDKALYYFLEIASAYLIFCDNYMAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWYARLQEWDNFYKFSNRAKNLLPRRTMTLTYYDGISRYMEGQVLHLQKQIKEQSENAQASGEELLKNLENLVAQNTTGPVFCPRLYHLMAYVCILMGDGQKCGLFLNTALRLSETQGNILEKCWLNMNKESWYSTSELKEDQWLQTILSLPSWEKIVAGRVNIQDLQKNKFLMRANTVDNHF

SEQ ID NO: 2788 - protein, 73 aa, Homo sapiens
  Payload ID: 647;
  Gene Symbol: ADCY10;
  Gene Name: adenylate cyclase 10 (soluble);
  ENSP ID: ENSP00000475192
MNTPKEEFQDWPIVRIAAHLPDLIVYGHFSPERPFMDYFDGVLMFVDISGKCKRDVCLMWMSNRLAWEFTCRA

SEQ ID NO: 2789 - protein, 250 aa, Homo sapiens
  Payload ID: 647;
  Gene Symbol: ADCY10;
  Gene Name: adenylate cyclase 10 (soluble);
  ENSP ID: ENSP00000476402
  MOD_RES (1)..(1): Any amino acid
XYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKRCMRLGDTASPYYILQV

SEQ ID NO: 2790 - protein, 1091 aa, Homo sapiens
  Payload ID: 648;
  Gene Symbol: ADCY2;
  Gene Name: adenylate cyclase 2 (brain);
  Uniprot ID:  Q08462;
  ENSP ID: ENSP00000342952
MWQEAMRRRRYLRDRSEEAAGGGDGLPRSRDWLYESYYCMSQQHPLIVFLLLIVMGSCLALLAVFFALGLEVEDHVAFLITVPTALAIFFAIFILVCIESVFKKLLRLFSLVIWICLVAMGYLFMCFGGTVSPWDQVSFFLFIIFVVYTMLPFNMRDAIIASVLTSSSHTIVLSVCLSATPGGKEHLVWQILANVIIFICGNLAGAYHKHLMELALQQTYQDTCNCIKSRIKLEFEKRQQERLLLSLLPAHIAMEMKAEIIQRLQGPKAGQMENTNNFHNLYVKRHTNVSILYADIVGFTRLASDCSPGELVHMLNELFGKFDQIAKENECMRIKILGDCYYCVSGLPISLPNHAKNCVKMGLDMCEAIKKVRDATGVDINMRVGVHSGNVLCGVIGLQKWQYDVWSHDVTLANHMEAGGVPGRVHISSVTLEHLNGAYKVEEGDGDIRDPYLKQHLVKTYFVINPKGERRSPQHLFRPRHTLDGAKMRASVRMTRYLESWGAAKPFAHLHHRDSMTTENGKISTTDVPMGQHNFQNRTLRTKSQKKRFEEELNERMIQAIDGINAQKQWLKSEDIQRISLLFYNKVLEKEYRATALPAFKYYVTCACLIFFCIFIVQILVLPKTSVLGISFGAAFLLLAFILFVCFAGQLLQCSKKASPLLMWLLKSSGIIANRPWPRISLTIITTAIILMMAVFNMFFLSDSEETIPPTANTTNTSFSASNNQVAILRAQNLFFLPYFIYSCILGLISCSVFLRVNYELKMLIMMVALVGYNTILLHTHAHVLGDYSQVLFERPGIWKDLKTMGSVSLSIFFITLLVLGRQNEYYCRLDFLWKNKFKKEREEIETMENLNRVLLENVLPAHVAEHFLARSLKNEELYHQSYDCVCVMFASIPDFKEFYTESDVNKEGLECLRLLNEIIADFDDLLSKPKFSGVEKIKTIGSTYMAATGLSAVPSQEHSQEPERQYMHIGTMVEFAFALVGKLDAINKHSFNDFKLRVGINHGPVIAGVIGAQKPQYDIWGNTVNVASRMDSTGVLDKIQVTEETSLVLQTLGYTCTCRGIINVKGKGDLKTYFVNTEMSRSLSQSNVAS

SEQ ID NO: 2791 - protein, 100 aa, Homo sapiens
  Payload ID: 648;
  Gene Symbol: ADCY2;
  Gene Name: adenylate cyclase 2 (brain);
  ENSP ID: ENSP00000425069
MELALQQTYQDTCNCIKSRIKLEFEKRQQERLLLSLLPAHIAMEMKAEIIQRLQGPKAGQMENTNNFHNLYVKRHTNVSILYADIVGFTRLASDCSPGEL

SEQ ID NO: 2792 - protein, 76 aa, Homo sapiens
  Payload ID: 648;
  Gene Symbol: ADCY2;
  Gene Name: adenylate cyclase 2 (brain);
  ENSP ID: ENSP00000426196
  MOD_RES (1)..(1): Any amino acid
XLGDYSQVLFERPGIWKDLKTMGSVSLSIFFITLLVLGRQVRLLMEEQIQKRAGGDRDHGEPEPRAAGERASRARG

SEQ ID NO: 2793 - protein, 1089 aa, Homo sapiens
  Payload ID: 648;
  Gene Symbol: ADCY2;
  Gene Name: adenylate cyclase 2 (brain);
  ENSP ID: ENSP00000444803
MWQEAMRRRRYLRDRSEEAAGGGDGLPRSRDWLYESYYCMSQQHPLIVFLLLIVMGSCLALLAVFFALGLEVEDHVAFLITVPTALAIFFAIFILVCIESVFKKLLRLFSLVIWICLVAMGYLFMCFGGTVSPWDQVSFFLFIIFVVYTMLPFNMRDAIIASVLTSSSHTIVLSVCLSATPGGKEHLADPGQCDHFHLWEPGGAYHKHLMELALQQTYQDTCNCIKSRIKLEFEKRQQERLLLSLLPAHIAMEMKAEIIQRLQGPKAGQMENTNNFHNLYVKRHTNVSILYADIVGFTRLASDCSPGELVHMLNELFGKFDQIAKENECMRIKILGDCYYCVSGLPISLPNHAKNCVKMGLDMCEAIKKVRDATGVDINMRVGVHSGNVLCGVIGLQKWQYDVWSHDVTLANHMEAGGVPGRVHISSVTLEHLNGAYKVEEGDGDIRDPYLKQHLVKTYFVINPKGERRSPQHLFRPRHTLDGAKMRASVRMTRYLESWGAAKPFAHLHHRDSMTTENGKISTTDVPMGQHNFQNRTLRTKSQKKRFEEELNERMIQAIDGINAQKQWLKSEDIQRISLLFYNKVLEKEYRATALPAFKYYVTCACLIFFCIFIVQILVLPKTSVLGISFGAAFLLLAFILFVCFAGQLLQCSKKASPLLMWLLKSSGIIANRPWPRISLTIITTAIILMMAVFNMFFLSDSEETIPPTANTTNTSFSASNNQVAILRAQNLFFLPYFIYSCILGLISCSVFLRVNYELKMLIMMVALVGYNTILLHTHAHVLGDYSQVLFERPGIWKDLKTMGSVSLSIFFITLLVLGRQNEYYCRLDFLWKNKFKKEREEIETMENLNRVLLENVLPAHVAEHFLARSLKNEELYHQSYDCVCVMFASIPDFKEFYTESDVNKEGLECLRLLNEIIADFDDLLSKPKFSGVEKIKTIGSTYMAATGLSAVPSQEHSQEPERQYMHIGTMVEFAFALVGKLDAINKHSFNDFKLRVGINHGPVIAGVIGAQKPQYDIWGNTVNVASRMDSTGVLDKIQVTEETSLVLQTLGYTCTCRGIINVKGKGDLKTYFVNTEMSRSLSQSNVAS

SEQ ID NO: 2794 - protein, 1144 aa, Homo sapiens
  Payload ID: 649;
  Gene Symbol: ADCY3;
  Gene Name: adenylate cyclase 3;
  Uniprot ID:  O60266;
  ENSP ID: ENSP00000260600
MPRNQGFSEPEYSAEYSAEYSVSLPSDPDRGVGRTHEISVRNSGSCLCLPRFMRLTFVPESLENLYQTYFKRQRHETLLVLVVFAALFDCYVVVMCAVVFSSDKLASLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 2795 - protein, 1145 aa, Homo sapiens
  Payload ID: 649;
  Gene Symbol: ADCY3;
  Gene Name: adenylate cyclase 3;
  ENSP ID: ENSP00000384484
MPRNQGFSEPEYSAEYSAEYSVSLPSDPDRGVGRTHEISVRNSGSCLCLPRFMRLTFVPESLENLYQTYFKRQRHETLLVLVVFAALFDCYVVVMCAVVFSSDKLASLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDSRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 2796 - protein, 482 aa, Homo sapiens
  Payload ID: 649;
  Gene Symbol: ADCY3;
  Gene Name: adenylate cyclase 3;
  ENSP ID: ENSP00000389799
MPRNQGFSEPEYSAEYSAEYSVSLPSDPDRGVGRTHEISVRNSGSCLCLPRFMRLTFVPESLENLYQTYFKRQRHETLLVLVVFAALFDCYVVVMCAVVFSSDKLASLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETK

SEQ ID NO: 2797 - protein, 298 aa, Homo sapiens
  Payload ID: 649;
  Gene Symbol: ADCY3;
  Gene Name: adenylate cyclase 3;
  ENSP ID: ENSP00000399275
CAIAVGIMSYYMADRKHRKAFLEARQSLEVKMNLEEQSQQQHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSG

SEQ ID NO: 2798 - protein, 154 aa, Homo sapiens
  Payload ID: 649;
  Gene Symbol: ADCY3;
  Gene Name: adenylate cyclase 3;
  ENSP ID: ENSP00000401455
MGLILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGL

SEQ ID NO: 2799 - protein, 198 aa, Homo sapiens
  Payload ID: 649;
  Gene Symbol: ADCY3;
  Gene Name: adenylate cyclase 3;
  ENSP ID: ENSP00000402008
VTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDSRLPLVPSKYSMTVMVFLMMLSFYYFSR

SEQ ID NO: 2800 - protein, 112 aa, Homo sapiens
  Payload ID: 649;
  Gene Symbol: ADCY3;
  Gene Name: adenylate cyclase 3;
  ENSP ID: ENSP00000406153
MPRNQGFSEPEYSAEYSAEYSVSLPSDPDRGVGRTHEISVRNSGSCLCLPRFMRLTFVPESLENLYQTYFKRQRHETLLVLVVFAALFDCYVVVMCAVVFSSDKLASLAVAG

SEQ ID NO: 2801 - protein, 791 aa, Homo sapiens
  Payload ID: 649;
  Gene Symbol: ADCY3;
  Gene Name: adenylate cyclase 3;
  ENSP ID: ENSP00000475652
QLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGGSKIEERLYSCVVAPTLRLRWERVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 2802 - protein, 49 aa, Homo sapiens
  Payload ID: 649;
  Gene Symbol: ADCY3;
  Gene Name: adenylate cyclase 3;
  ENSP ID: ENSP00000476143
  MOD_RES (1)..(1): Any amino acid
XYDIWGNTVNVASRMESTGVMGNIQWRLAEKLHERGKGTEEQAVAVSRW

SEQ ID NO: 2803 - protein, 1077 aa, Homo sapiens
  Payload ID: 650;
  Gene Symbol: ADCY4;
  Gene Name: adenylate cyclase 4;
  Uniprot ID:  Q8NFM4;
  ENSP ID: ENSP00000312126
MARLFSPRPPPSEDLFYETYYSLSQQYPLLLLLLGIVLCALAALLAVAWASGRELTSDPSFLTTVLCALGGFSLLLGLASREQRLQRWTRPLSGLVWVALLALGHAFLFTGGVVSAWDQVSYFLFVIFTAYAMLPLGMRDAAVAGLASSLSHLLVLGLYLGPQPDSRPALLPQLAANAVLFLCGNVAGVYHKALMERALRATFREALSSLHSRRRLDTEKKHQEHLLLSILPAYLAREMKAEIMARLQAGQGSRPESTNNFHSLYVKRHQGVSVLYADIVGFTRLASECSPKELVLMLNELFGKFDQIAKEHECMRIKILGDCYYCVSGLPLSLPDHAINCVRMGLDMCRAIRKLRAATGVDINMRVGVHSGSVLCGVIGLQKWQYDVWSHDVTLANHMEAGGVPGRVHITGATLALLAGAYAVEDAGMEHRDPYLRELGEPTYLVIDPRAEEEDEKGTAGGLLSSLEGLKMRPSLLMTRYLESWGAAKPFAHLSHGDSPVSTSTPLPEKTLASFSTQWSLDRSRTPRGLDDELDTGDAKFFQVIEQLNSQKQWKQSKDFNPLTLYFREKEMEKEYRLSAIPAFKYYEACTFLVFLSNFIIQMLVTNRPPALAITYSITFLLFLLILFVCFSEDLMRCVLKGPKMLHWLPALSGLVATRPGLRIALGTATILLVFAMAITSLFFFPTSSDCPFQAPNVSSMISNLSWELPGSLPLISVPYSMHCCTLGFLSCSLFLHMSFELKLLLLLLWLAASCSLFLHSHAWLSECLIVRLYLGPLDSRPGVLKEPKLMGAISFFIFFFTLLVLARQNEYYCRLDFLWKKKLRQEREETETMENLTRLLLENVLPAHVAPQFIGQNRRNEDLYHQSYECVCVLFASVPDFKEFYSESNINHEGLECLRLLNEIIADFDELLSKPKFSGVEKIKTIGSTYMAATGLNATSGQDAQQDAERSCSHLGTMVEFAVALGSKLDVINKHSFNNFRLRVGLNHGPVVAGVIGAQKPQYDIWGNTVNVASRMESTGVLGKIQVTEETAWALQSLGYTCYSRGVIKVKGKGQLCTYFLNTDLTRTGPPSATLG

SEQ ID NO: 2804 - protein, 1077 aa, Homo sapiens; identical to SEQ ID NO: 2803
  Payload ID: 650;
  Gene Symbol: ADCY4;
  Gene Name: adenylate cyclase 4;
  Uniprot ID:  Q8NFM4;
  ENSP ID: ENSP00000393177

SEQ ID NO: 2805 - protein, 449 aa, Homo sapiens
  Payload ID: 650;
  Gene Symbol: ADCY4;
  Gene Name: adenylate cyclase 4;
  ENSP ID: ENSP00000450477
MARLFSPRPPPSEDLFYETYYSLSQQYPLLLLLLGIVLCALAALLAVAWASGRELTSDPSFLTTVLCALGGFSLLLGLASREQRLQRWTRPLSGLVWVALLALGHAFLFTGGVVSAWDQVSYFLFVIFTAYAMLPLGMRDAAVAGLASSLSHLLVLGLYLGPQPDSRPALLPQLAANAVLFLCGNVAGVYHKALMERALRATFREALSSLHSRRRLDTEKKHQEHLLLSILPAYLAREMKAEIMARLQAGQGSRPESTNNFHSLYVKRHQGVSVLYADIVGFTRLASECSPKELVLMLNELFGKFDQIAKVPLHTHIHTPRSMNACGSRSWGTVTTVSLGCHSHCQTMPSTACAWAWTCAGPSGNCGQPLAWTSTCVWACTQAAYCVESSGCRSGSTTFGHMMSHWLTTWRQAVYQGECTSQGLPWPCWQGLMLWRTQAWSIGTPTFGS

SEQ ID NO: 2806 - protein, 216 aa, Homo sapiens
  Payload ID: 650;
  Gene Symbol: ADCY4;
  Gene Name: adenylate cyclase 4;
  ENSP ID: ENSP00000450481
MLPLGMRDAAVAGLASSLSHLLVLGLYLGPQPDSRPALLPQLAANAVLFLCGNVAGVYHKALMERALRATFREALSSLHSRRRLDTEKKHQEHLLLSILPAYLAREMKAEIMARLQAGQGSRPESTNNFHSLYVKRHQGVSVLYADIVGFTRLASECSPKELVLMLNELFGKFDQIAKETAGSHWRGHQHACGRALRQRTVWSHRAAEVAVRRLVT

SEQ ID NO: 2807 - protein, 137 aa, Homo sapiens
  Payload ID: 650;
  Gene Symbol: ADCY4;
  Gene Name: adenylate cyclase 4;
  ENSP ID: ENSP00000450843
  MOD_RES (1)..(1): Any amino acid
XMEHRDPYLRELGEPTYLVIDPRAEEEDEKGTAGGLLSSLEGLKMRPSLLMTRYLESWGAAKPFAHLSHGDSPVSTSTPLPEKTLASFSTQWSLDRSRTPRGLDDELDTGDAKFFQTVEAVEGLQPTDTVLQREGDG

SEQ ID NO: 2808 - protein, 1077 aa, Homo sapiens; identical to SEQ ID NO: 2803
  Payload ID: 650;
  Gene Symbol: ADCY4;
  Gene Name: adenylate cyclase 4;
  Uniprot ID:  Q8NFM4;
  ENSP ID: ENSP00000452250

SEQ ID NO: 2809 - protein, 36 aa, Homo sapiens
  Payload ID: 650;
  Gene Symbol: ADCY4;
  Gene Name: adenylate cyclase 4;
  ENSP ID: ENSP00000453259
MLPLGMRDAAVAGLASSLSHLLVLGLYLGPQPDSRP

SEQ ID NO: 2810 - protein, 115 aa, Homo sapiens
  Payload ID: 650;
  Gene Symbol: ADCY4;
  Gene Name: adenylate cyclase 4;
  ENSP ID: ENSP00000453893
MARLFSPRPPPSEDLFYETYYSLSQQYPLLLLLLGIVLCALAALLAVAWASGRELTSDPSFLTTVLCALGGFSLLLGLASREQRLQRWTRPLSGLVWVALLALGHAFLFTGGVVS

SEQ ID NO: 2811 - protein, 911 aa, Homo sapiens
  Payload ID: 651;
  Gene Symbol: ADCY5;
  Gene Name: adenylate cyclase 5;
  Uniprot ID:  O95622;
  ENSP ID: ENSP00000308685
MKSQKEGCCSRGDLSIQTGPGGEWAPRRLVSNVLIFSCTNIVGVCTHYPAEVSQRQAFQETRECIQARLHSQRENQQQERLLLSVLPRHVAMEMKADINAKQEDMMFHKIYIQKHDNVSILFADIEGFTSLASQCTAQELVMTLNELFARFDKLAAENHCLRIKILGDCYYCVSGLPEARADHAHCCVEMGMDMIEAISLVREVTGVNVNMRVGIHSGRVHCGVLGLRKWQFDVWSNDVTLANHMEAGGKAGRIHITKATLNYLNGDYEVEPGCGGERNAYLKEHSIETFLILRCTQKRKEEKAMIAKMNRQRTNSIGHNPPHWGAERPFYNHLGGNQVSKEMKRMGFEDPKDKNAQESANPEDEVDEFLGRAIDARSIDRLRSEHVRKFLLTFREPDLEKKYSKQVDDRFGAYVACASLVFLFICFVQITIVPHSIFMLSFYLTCSLLLTLVVFVSVIYSCVKLFPSPLQTLSRKIVRSKMNSTLVGVFTITLVFLAAFVNMFTCNSRDLLGCLAQEHNISASQVNACHVAESAVNYSLGDEQGFCGSPWPNCNFPEYFTYSVLLSLLACSVFLQISCIGKLVLMLAIELIYVLIVEVPGVTLFDNADLLVTANAIDFFNNGTSQCPEHATKVALKVVTPIIISVFVLALYLHAQQVESTARLDFLWKLQATEEKEEMEELQAYNRRLLHNILPKDVAAHFLARERRNDELYYQSCECVAVMFASIANFSEFYVELEANNEGVECLRLLNEIIADFDEIISEDRFRQLEKIKTIGSTYMAASGLNDSTYDKVGKTHIKALADFAMKLMDQMKYINEHSFNNFQMKIGLNIGPVVAGVIGARKPQYDIWGNTVNVASRMDSTGVPDRIQVTTDMYQVLAANTYQLECRGVVKVKGKGEMMTYFLNGGPPLS

SEQ ID NO: 2812 - protein, 78 aa, Homo sapiens
  Payload ID: 651;
  Gene Symbol: ADCY5;
  Gene Name: adenylate cyclase 5;
  ENSP ID: ENSP00000417789
MAPSRFRTQLEVSLSPMFSFSPAPTSWVSAPTIRLRSPRDRLSRRPESASRRGSTRSGRTSSRNGSCCLSFPVMLPWR

SEQ ID NO: 2813 - protein, 919 aa, Homo sapiens
  Payload ID: 651;
  Gene Symbol: ADCY5;
  Gene Name: adenylate cyclase 5;
  ENSP ID: ENSP00000418537
MAPSRFRTQLELVSNVLIFSCTNIVGVCTHYPAEVSQRQAFQETRECIQARLHSQRENQQQERLLLSVLPRHVAMEMKADINAKQEDMMFHKIYIQKHDNVSILFADIEGFTSLASQCTAQELVMTLNELFARFDKLAAENHCLRIKILGDCYYCVSGLPEARADHAHCCVEMGMDMIEAISLVREVTGVNVNMRVGIHSGRVHCGVLGLRKWQFDVWSNDVTLANHMEAGGKAGRIHITKATLNYLNGDYEVEPGCGGERNAYLKEHSIETFLILRCTQKRKEEKAMIAKMNRQRTNSIGHNPPHWGAERPFYNHLGGNQVSKEMKRMGFEDPKDKNAQESANPEDEVDEFLGRAIDARSIDRLRSEHVRKFLLTFREPDLEKKYSKQVDDRFGAYVACASLVFLFICFVQITIVPHSIFMLSFYLTCSLLLTLVVFVSVIYSCVKLFPSPLQTLSRKIVRSKMNSTLVGVFTITLVFLAAFVNMFTCNSRDLLGCLAQEHNISASQVNACHVAESAVNYSLGDEQGFCGSPWPNCNFPEYFTYSVLLSLLACSVFLQISCIGKLVLMLAIELIYVLIVEVPGVTLFDNADLLVTANAIDFFNNGTSQWSLCENLRHRRMEAGTYFPSGVKEQSPEHATKVALKVVTPIIISVFVLALYLHAQQVESTARLDFLWKLQATEEKEEMEELQAYNRRLLHNILPKDVAAHFLARERRNDELYYQSCECVAVMFASIANFSEFYVELEANNEGVECLRLLNEIIADFDEIISEDRFRQLEKIKTIGSTYMAASGLNDSTYDKVGKTHIKALADFAMKLMDQMKYINEHSFNNFQMKIGLNIGPVVAGVIGARKPQYDIWGNTVNVASRMDSTGVPDRIQVTTDMYQVLAANTYQLECRGVVKVKGKGEMMTYFLNGGPPLS

SEQ ID NO: 2814 - protein, 1261 aa, Homo sapiens
  Payload ID: 651;
  Gene Symbol: ADCY5;
  Gene Name: adenylate cyclase 5;
  Uniprot ID:  O95622;
  ENSP ID: ENSP00000419361
MSGSKSVSPPGYAAQKTAAPAPRGGPEHRSAWGEADSRANGYPHAPGGSARGSTKKPGGAVTPQQQQRLASRWRSDDDDDPPLSGDDPLAGGFGFSFRSKSAWQERGGDDCGRGSRRQRRGAASGGSTRAPPAGGGGGSAAAAASAGGTEVRPRSVEVGLEERRGKGRAADELEAGAVEGGEGSGDGGSSADSGSGAGPGAVLSLGACCLALLQIFRSKKFPSDKLERLYQRYFFRLNQSSLTMLMAVLVLVCLVMLAFHAARPPLQLPYLAVLAAAVGVILIMAVLCNRAAFHQDHMGLACYALIAVVLAVQVVGLLLPQPRSASEGIWWTVFFIYTIYTLLPVRMRAAVLSGVLLSALHLAIALRTNAQDQFLLKQLVSNVLIFSCTNIVGVCTHYPAEVSQRQAFQETRECIQARLHSQRENQQQERLLLSVLPRHVAMEMKADINAKQEDMMFHKIYIQKHDNVSILFADIEGFTSLASQCTAQELVMTLNELFARFDKLAAENHCLRIKILGDCYYCVSGLPEARADHAHCCVEMGMDMIEAISLVREVTGVNVNMRVGIHSGRVHCGVLGLRKWQFDVWSNDVTLANHMEAGGKAGRIHITKATLNYLNGDYEVEPGCGGERNAYLKEHSIETFLILRCTQKRKEEKAMIAKMNRQRTNSIGHNPPHWGAERPFYNHLGGNQVSKEMKRMGFEDPKDKNAQESANPEDEVDEFLGRAIDARSIDRLRSEHVRKFLLTFREPDLEKKYSKQVDDRFGAYVACASLVFLFICFVQITIVPHSIFMLSFYLTCSLLLTLVVFVSVIYSCVKLFPSPLQTLSRKIVRSKMNSTLVGVFTITLVFLAAFVNMFTCNSRDLLGCLAQEHNISASQVNACHVAESAVNYSLGDEQGFCGSPWPNCNFPEYFTYSVLLSLLACSVFLQISCIGKLVLMLAIELIYVLIVEVPGVTLFDNADLLVTANAIDFFNNGTSQCPEHATKVALKVVTPIIISVFVLALYLHAQQVESTARLDFLWKLQATEEKEEMEELQAYNRRLLHNILPKDVAAHFLARERRNDELYYQSCECVAVMFASIANFSEFYVELEANNEGVECLRLLNEIIADFDEIISEDRFRQLEKIKTIGSTYMAASGLNDSTYDKVGKTHIKALADFAMKLMDQMKYINEHSFNNFQMKIGLNIGPVVAGVIGARKPQYDIWGNTVNVASRMDSTGVPDRIQVTTDMYQVLAANTYQLECRGVVKVKGKGEMMTYFLNGGPPLS

SEQ ID NO: 2815 - protein, 492 aa, Homo sapiens
  Payload ID: 651;
  Gene Symbol: ADCY5;
  Gene Name: adenylate cyclase 5;
  ENSP ID: ENSP00000420082
MEMKADINAKQEDMMFHKIYIQKHDNVSILFADIEGFTSLASQCTAQELVMTLNELFARFDKLAAENHCLRIKILGDCYYCVSGLPEARADHAHCCVEMGMDMIEAISLVREVTGVNVNMRVGIHSGRVHCGVLGLRKWQFDVWSNDVTLANHMEAGGKAGRIHITKATLNYLNGDYEVEPGCGGERNAYLKEHSIETFLILRCTQKRKEEKAMIAKMNRQRTNSIGHNPPHWGAERPFYNHLGGNQVSKEMKRMGFEDPKDKNAQESANPEDEVDEFLGRAIDARSIDRLRSEHVRKFLLTFREPDLEKKYSKQVDDRFGAYVACASLVFLFICFVQITIVPHSIFMLSFYLTCSLLLTLVVFVSVIYSCVKLFPSPLQTLSRKIVRSKMNSTLVGVFTITLVFLAAFVNMFTCNSRDLLGCLAQEHNISASQVNACHVAESAVNYSLGDEQGFCGSPWPNCNFPEYFTYSVLLSLLACSVFLQISCIGKL

SEQ ID NO: 2816 - protein, 90 aa, Homo sapiens
  Payload ID: 651;
  Gene Symbol: ADCY5;
  Gene Name: adenylate cyclase 5;
  ENSP ID: ENSP00000420252
MEMKADINAKQEDMMFHKIYIQKHDNVSILFADIEGFTSLASQCTAQELVMTLNELFARFDKLAAENHCLRIKILGDCYYCVSGLPEARA

SEQ ID NO: 2817 - protein, 1168 aa, Homo sapiens
  Payload ID: 652;
  Gene Symbol: ADCY6;
  Gene Name: adenylate cyclase 6;
  Uniprot ID:  O43306;
  ENSP ID: ENSP00000311405
MSWFSGLLVPKVDERKTAWGERNGQKRSRRRGTRAGGFCTPRYMSCLRDAEPPSPTPAGPPRCPWQDDAFIRRGGPGKGKELGLRAVALGFEDTEVTTTAGGTAEVAPDAVPRSGRSCWRRLVQVFQSKQFRSAKLERLYQRYFFQMNQSSLTLLMAVLVLLTAVLLAFHAAPARPQPAYVALLACAAALFVGLMVVCNRHSFRQDSMWVVSYVVLGILAAVQVGGALAADPRSPSAGLWCPVFFVYIAYTLLPIRMRAAVLSGLGLSTLHLILAWQLNRGDAFLWKQLGANVLLFLCTNVIGICTHYPAEVSQRQAFQETRGYIQARLHLQHENRQQERLLLSVLPQHVAMEMKEDINTKKEDMMFHKIYIQKHDNVSILFADIEGFTSLASQCTAQELVMTLNELFARFDKLAAENHCLRIKILGDCYYCVSGLPEARADHAHCCVEMGVDMIEAISLVREVTGVNVNMRVGIHSGRVHCGVLGLRKWQFDVWSNDVTLANHMEAGGRAGRIHITRATLQYLNGDYEVEPGRGGERNAYLKEQHIETFLILGASQKRKEEKAMLAKLQRTRANSMEGLMPRWVPDRAFSRTKDSKAFRQMGIDDSSKDNRGTQDALNPEDEVDEFLSRAIDARSIDQLRKDHVRRFLLTFQREDLEKKYSRKVDPRFGAYVACALLVFCFICFIQLLIFPHSTLMLGIYASIFLLLLITVLICAVYSCGSLFPKALQRLSRSIVRSRAHSTAVGIFSVLLVFTSAIANMFTCNHTPIRSCAARMLNLTPADITACHLQQLNYSLGLDAPLCEGTMPTCSFPEYFIGNMLLSLLASSVFLHISSIGKLAMIFVLGLIYLVLLLLGPPATIFDNYDLLLGVHGLASSNETFDGLDCPAAGRVALKYMTPVILLVFALALYLHAQQVESTARLDFLWKLQATGEKEEMEELQAYNRRLLHNILPKDVAAHFLARERRNDELYYQSCECVAVMFASIANFSEFYVELEANNEGVECLRLLNEIIADFDEIISEERFRQLEKIKTIGSTYMAASGLNASTYDQVGRSHITALADYAMRLMEQMKHINEHSFNNFQMKIGLNMGPVVAGVIGARKPQYDIWGNTVNVSSRMDSTGVPDRIQVTTDLYQVLAAKGYQLECRGVVKVKGKGEMTTYFLNGGPSS

SEQ ID NO: 2818 - protein, 1115 aa, Homo sapiens
  Payload ID: 652;
  Gene Symbol: ADCY6;
  Gene Name: adenylate cyclase 6;
  Uniprot ID:  O43306;
  ENSP ID: ENSP00000350536
MSWFSGLLVPKVDERKTAWGERNGQKRSRRRGTRAGGFCTPRYMSCLRDAEPPSPTPAGPPRCPWQDDAFIRRGGPGKGKELGLRAVALGFEDTEVTTTAGGTAEVAPDAVPRSGRSCWRRLVQVFQSKQFRSAKLERLYQRYFFQMNQSSLTLLMAVLVLLTAVLLAFHAAPARPQPAYVALLACAAALFVGLMVVCNRHSFRQDSMWVVSYVVLGILAAVQVGGALAADPRSPSAGLWCPVFFVYIAYTLLPIRMRAAVLSGLGLSTLHLILAWQLNRGDAFLWKQLGANVLLFLCTNVIGICTHYPAEVSQRQAFQETRGYIQARLHLQHENRQQERLLLSVLPQHVAMEMKEDINTKKEDMMFHKIYIQKHDNVSILFADIEGFTSLASQCTAQELVMTLNELFARFDKLAAENHCLRIKILGDCYYCVSGLPEARADHAHCCVEMGVDMIEAISLVREVTGVNVNMRVGIHSGRVHCGVLGLRKWQFDVWSNDVTLANHMEAGGRAGRIHITRATLQYLNGDYEVEPGRGGERNAYLKEQHIETFLILGASQKRKEEKAMLAKLQRTRANSMEGLMPRWVPDRAFSRTKDSKAFRQMGIDDSSKDNRGTQDALNPEDEVDEFLSRAIDARSIDQLRKDHVRRFLLTFQREDLEKKYSRKVDPRFGAYVACALLVFCFICFIQLLIFPHSTLMLGIYASIFLLLLITVLICAVYSCGSLFPKALQRLSRSIVRSRAHSTAVGIFSVLLVFTSAIANMYFIGNMLLSLLASSVFLHISSIGKLAMIFVLGLIYLVLLLLGPPATIFDNYDLLLGVHGLASSNETFDGLDCPAAGRVALKYMTPVILLVFALALYLHAQQVESTARLDFLWKLQATGEKEEMEELQAYNRRLLHNILPKDVAAHFLARERRNDELYYQSCECVAVMFASIANFSEFYVELEANNEGVECLRLLNEIIADFDEIISEERFRQLEKIKTIGSTYMAASGLNASTYDQVGRSHITALADYAMRLMEQMKHINEHSFNNFQMKIGLNMGPVVAGVIGARKPQYDIWGNTVNVSSRMDSTGVPDRIQVTTDLYQVLAAKGYQLECRGVVKVKGKGEMTTYFLNGGPSS

SEQ ID NO: 2819 - protein, 1115 aa, Homo sapiens; identical to SEQ ID NO: 2818
  Payload ID: 652;
  Gene Symbol: ADCY6;
  Gene Name: adenylate cyclase 6;
  Uniprot ID:  O43306;
  ENSP ID: ENSP00000446730

SEQ ID NO: 2820 - protein, 82 aa, Homo sapiens
  Payload ID: 652;
  Gene Symbol: ADCY6;
  Gene Name: adenylate cyclase 6;
  ENSP ID: ENSP00000447702
MVTVCLCHLLQLGANVLLFLCTNVIGICTHYPAEVSQRQAFQETRGYIQARLHLQHENRQQERLLLSVLPQHVAMEMKEDIN

SEQ ID NO: 2821 - protein, 1080 aa, Homo sapiens
  Payload ID: 653;
  Gene Symbol: ADCY7;
  Gene Name: adenylate cyclase 7;
  Uniprot ID:  P51828;
  ENSP ID: ENSP00000254235
MPAKGRYFLNEGEEGPDQDALYEKYQLTSQHGPLLLTLLLVAATACVALIIIAFSQGDPSRHQAILGMAFLVLAVFAALSVLMYVECLLRRWLRALALLTWACLVALGYVLVFDAWTKAACAWEQVPFFLFIVFVVYTLLPFSMRGAVAVGAVSTASHLLVLGSLMGGFTTPSVRVGLQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLPLMPFQVPELPVGNETGLLAASSKTRALCEPLPYYTCSCVLGFIACSVFLRMSLEPKVVLLTVALVAYLVLFNLSPCWQWDCCGQGLGNLTKPNGTTSGTPSCSWKDLKTMTNFYLVLFYITLLTLSRQIDYYCRLDCLWKKKFKKEHEEFETMENVNRLLLENVLPAHVAAHFIGDKLNEDWYHQSYDCVCVMFASVPDFKVFYTECDVNKEGLECLRLLNEIIADFDELLLKPKFSGVEKIKTIGSTYMAAAGLSVASGHENQELERQHAHIGVMVEFSIALMSKLDGINRHSFNSFRLRVGINHGPVIAGVIGARKPQYDIWGNTVNVASRMESTGELGKIQVTEETCTILQGLGYSCECRGLINVKGKGELRTYFVCTDTAKFQGLGLN

SEQ ID NO: 2822 - protein, 1080 aa, Homo sapiens; identical to SEQ ID NO: 2821
  Payload ID: 653;
  Gene Symbol: ADCY7;
  Gene Name: adenylate cyclase 7;
  Uniprot ID:  P51828;
  ENSP ID: ENSP00000378187

SEQ ID NO: 2823 - protein, 433 aa, Homo sapiens
  Payload ID: 653;
  Gene Symbol: ADCY7;
  Gene Name: adenylate cyclase 7;
  ENSP ID: ENSP00000437788
MPAKGRYFLNEGEEGPDQDALYEKYQLTSQHGPLLLTLLLVAATACVALIIIAFSQGDPSRHQAILGMAFLVLAVFAALSVLMYVECLLRRWLRALALLTWACLVALGYVLVFDAWTKAACAWEQVPFFLFIVFVVYTLLPFSMRGAVAVGAVSTASHLLVLGSLMGGFTTPSVRVGLQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKALLLQVR

SEQ ID NO: 2824 - protein, 108 aa, Homo sapiens
  Payload ID: 653;
  Gene Symbol: ADCY7;
  Gene Name: adenylate cyclase 7;
  ENSP ID: ENSP00000454301
MPAKGRYFLNEGEEGPDQDALYEKYQLTSQHGPLLLTLLLVAATACVALIIIAFSQGRHGLAMLPRLVLNSWPQVILLPWPPKVLGLQDPSRHQAILGMAFLVLAVFA

SEQ ID NO: 2825 - protein, 530 aa, Homo sapiens
  Payload ID: 653;
  Gene Symbol: ADCY7;
  Gene Name: adenylate cyclase 7;
  ENSP ID: ENSP00000455670
MPAKGRYFLNEGEEGPDQDALYEKYQLTSQHGPLLLTLLLVAATACVALIIIAFSQGDPSRHQAILGMAFLVLAVFAALSVLMYVECLLRRWLRALALLTWACLVALGYVLVFDAWTKAACAWEQVPFFLFIVFVVYTLLPFSMRGAVAVGAVSTASHLLVLGSLMGGFTTPSVRVGLQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSERSPAPPPDPRQKHVPQGAVGG

SEQ ID NO: 2826 - protein, 734 aa, Homo sapiens
  Payload ID: 653;
  Gene Symbol: ADCY7;
  Gene Name: adenylate cyclase 7;
  ENSP ID: ENSP00000457409
MPAKGRYFLNEGEEGPDQDALYEKYQLTSQHGPLLLTLLLVAATACVALIIIAFSQGDPSRHQAILGMAFLVLAVFAALSVLMYVECLLRRWLRALALLTWACLVALGYVLVFDAWTKAACAWEQVPFFLFIVFVVYTLLPFSMRGAVAVGAVSTASHLLVLGSLMGGFTTPSVRVGLQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLPLMPFQVPELPVGNETGLLAASSKTRALCEPLPHLHTVFSRLNELTS

SEQ ID NO: 2827 - protein, 17 aa, Homo sapiens
  Payload ID: 653;
  Gene Symbol: ADCY7;
  Gene Name: adenylate cyclase 7;
  ENSP ID: ENSP00000460018
MPAKGRYFLNEGEEGPD

SEQ ID NO: 2828 - protein, 81 aa, Homo sapiens
  Payload ID: 653;
  Gene Symbol: ADCY7;
  Gene Name: adenylate cyclase 7;
  ENSP ID: ENSP00000460636
MPAKGRYFLNEGEEGPDQDALYEKYQLTSQHGPLLLTLLLVAATACVALIIIAFSQGDPSRHQAILGMAFLVLAVFAALSV

SEQ ID NO: 2829 - protein, 1251 aa, Homo sapiens
  Payload ID: 654;
  Gene Symbol: ADCY8;
  Gene Name: adenylate cyclase 8 (brain);
  Uniprot ID:  P40145;
  ENSP ID: ENSP00000286355
MELSDVRCLTGSEELYTIHPTPPAGDGRSASRPQRLLWQTAVRHITEQRFIHGHRGGSGSGSGGSGKASDPAGGGPNHHAPQLSGDSALPLYSLGPGERAHSTCGTKVFPERSGSGSASGSGGGGDLGFLHLDCAPSNSDFFLNGGYSYRGVIFPTLRNSFKSRDLERLYQRYFLGQRRKSEVVMNVLDVLTKLTLLVLHLSLASAPMDPLKGILLGFFTGIEVVICALVVVRKDTTSHTYLQYSGVVTWVAMTTQILAAGLGYGLLGDGIGYVLFTLFATYSMLPLPLTWAILAGLGTSLLQVILQVVIPRLAVISINQVVAQAVLFMCMNTAGIFISYLSDRAQRQAFLETRRCVEARLRLETENQRQERLVLSVLPRFVVLEMINDMTNVEDEHLQHQFHRIYIHRYENVSILFADVKGFTNLSTTLSAQELVRMLNELFARFDRLAHEHHCLRIKILGDCYYCVSGLPEPRQDHAHCCVEMGLSMIKTIRYVRSRTKHDVDMRIGIHSGSVLCGVLGLRKWQFDVWSWDVDIANKLESGGIPGRIHISKATLDCLNGDYNVEEGHGKERNEFLRKHNIETYLIKQPEDSLLSLPEDIVKESVSSSDRRNSGATFTEGSWSPELPFDNIVGKQNTLAALTRNSINLLPNHLAQALHVQSGPEEINKRIEHTIDLRSGDKLRREHIKPFSLMFKDSSLEHKYSQMRDEVFKSNLVCAFIVLLFITAIQSLLPSSRVMPMTIQFSILIMLHSALVLITTAEDYKCLPLILRKTCCWINETYLARNVIIFASILINFLGAILNILWCDFDKSIPLKNLTFNSSAVFTDICSYPEYFVFTGVLAMVTCAVFLRLNSVLKLAVLLIMIAIYALLTETVYAGLFLRYDNLNHSGEDFLGTKEVSLLLMAMFLLAVFYHGQQLEYTARLDFLWRVQAKEEINEMKELREHNENMLRNILPSHVARHFLEKDRDNEELYSQSYDAVGVMFASIPGFADFYSQTEMNNQGVECLRLLNEIIADFDELLGEDRFQDIEKIKTIGSTYMAVSGLSPEKQQCEDKWGHLCALADFSLALTESIQEINKHSFNNFELRIGISHGSVVAGVIGAKKPQYDIWGKTVNLASRMDSTGVSGRIQVPEETYLILKDQGFAFDYRGEIYVKGISEQEGKIKTYFLLGRVQPNPFILPPRRLPGQYSLAAVVLGLVQSLNRQRQKQLLNENNNTGIIKGHYNRRTLLSPSGTEPGAQAEGTDKSDLP

SEQ ID NO: 2830 - protein, 1120 aa, Homo sapiens
  Payload ID: 654;
  Gene Symbol: ADCY8;
  Gene Name: adenylate cyclase 8 (brain);
  ENSP ID: ENSP00000367161
MELSDVRCLTGSEELYTIHPTPPAGDGRSASRPQRLLWQTAVRHITEQRFIHGHRGGSGSGSGGSGKASDPAGGGPNHHAPQLSGDSALPLYSLGPGERAHSTCGTKVFPERSGSGSASGSGGGGDLGFLHLDCAPSNSDFFLNGGYSYRGVIFPTLRNSFKSRDLERLYQRYFLGQRRKSEVVMNVLDVLTKLTLLVLHLSLASAPMDPLKGILLGFFTGIEVVICALVVVRKDTTSHTYLQYSGVVTWVAMTTQILAAGLGYGLLGDGIGYVLFTLFATYSMLPLPLTWAILAGLGTSLLQVILQVVIPRLAVISINQVVAQAVLFMCMNTAGIFISYLSDRAQRQAFLETRRCVEARLRLETENQRQERLVLSVLPRFVVLEMINDMTNVEDEHLQHQFHRIYIHRYENVSILFADVKGFTNLSTTLSAQELVRMLNELFARFDRLAHEHHCLRIKILGDCYYCVSGLPEPRQDHAHCCVEMGLSMIKTIRYVRSRTKHDVDMRIGIHSGSVLCGVLGLRKWQFDVWSWDVDIANKLESGGIPGRIHISKATLDCLNGDYNVEEGHGKERNEFLRKHNIETYLIKQPEDSLLSLPEDIVKESVSSSDRRNSGATFTEGSWSPELPFDNIVGKQNTLAALTRNSINLLPNHLAQALHVQSGPEEINKRIEHTIDLRSGDKLRREHIKPFSLMFKDSSLEHKYFVFTGVLAMVTCAVFLRLNSVLKLAVLLIMIAIYALLTETVYAGLFLRYDNLNHSGEDFLGTKEVSLLLMAMFLLAVFYHGQQLEYTARLDFLWRVQAKEEINEMKELREHNENMLRNILPSHVARHFLEKDRDNEELYSQSYDAVGVMFASIPGFADFYSQTEMNNQGVECLRLLNEIIADFDELLGEDRFQDIEKIKTIGSTYMAVSGLSPEKQQCEDKWGHLCALADFSLALTESIQEINKHSFNNFELRIGISHGSVVAGVIGAKKPQYDIWGKTVNLASRMDSTGVSGRIQVPEETYLILKDQGFAFDYRGEIYVKGISEQEGKIKTYFLLGRVQPNPFILPPRRLPGQYSLAAVVLGLVQSLNRQRQKQLLNENNNTGIIKGHYNRRTLLSPSGTEPGAQAEGTDKSDLP

SEQ ID NO: 2831 - protein, 252 aa, Homo sapiens
  Payload ID: 654;
  Gene Symbol: ADCY8;
  Gene Name: adenylate cyclase 8 (brain);
  ENSP ID: ENSP00000428010
MINDMTNVEDEHLQHQFHRIYIHRYENVSILFADVKGFTNLSTTLSAQELVRMLNELFARFDRLAHEHHCLRIKILGDCYYCVSGLPEPRQDHAHCCVEMGLSMIKTIRYVRSRTKHDVDMRIGIHSGSVLCGVLGLRKWQFDVWSWDVDIANKLESGGIPGRIHISKATLDCLNGDYNVEEGHGKERNEFLRKHNIETYLIKQPEDSLLSLPEDIVKESVSSSDRRNSGATFTEGSWSPELPFDNIVGKQN

SEQ ID NO: 2832 - protein, 1353 aa, Homo sapiens
  Payload ID: 655;
  Gene Symbol: ADCY9;
  Gene Name: adenylate cyclase 9;
  Uniprot ID:  O60503;
  ENSP ID: ENSP00000294016
MASPPHQQLLHHHSTEVSCDSSGDSNSVRVKINPKQLSSNSHPKHCKYSISSSCSSSGDSGGVPRRVGGGGRLRRQKKLPQLFERASSRWWDPKFDSVNLEEACLERCFPQTQRRFRYALFYIGFACLLWSIYFAVHMRSRLIVMVAPALCFLLVCVGFFLFTFTKLYARHYAWTSLALTLLVFALTLAAQFQVLTPVSGRGDSSNLTATARPTDTCLSQVGSFSMCIEVLFLLYTVMHLPLYLSLCLGVAYSVLFETFGYHFRDEACFPSPGAGALHWELLSRGLLHGCIHAIGVHLFVMSQVRSRSTFLKVGQSIMHGKDLEVEKALKERMIHSVMPRIIADDLMKQGDEESENSVKRHATSSPKNRKKKSSIQKAPIAFRPFKMQQIEEVSILFADIVGFTKMSANKSAHALVGLLNDLFGRFDRLCEETKCEKISTLGDCYYCVAGCPEPRADHAYCCIEMGLGMIKAIEQFCQEKKEMVNMRVGVHTGTVLCGILGMRRFKFDVWSNDVNLANLMEQLGVAGKVHISEATAKYLDDRYEMEDGKVIERLGQSVVADQLKGLKTYLISGQRAKESRCSCAEALLSGFEVIDGSQVSSGPRGQGTASSGNVSDLAQTVKTFDNLKTCPSCGITFAPKSEAGAEGGAPQNGCQDEHKNSTKASGGPNPKTQNGLLSPPQEEKLTNSQTSLCEILQEKGRWAGVSLDQSALLPLRFKNIREKTDAHFVDVIKEDSLMKDYFFKPPINQFSLNFLDQELERSYRTSYQEEVIKNSPVKTFASPTFSSLLDVFLSTTVFLTLSTTCFLKYEAATVPPPPAALAVFSAALLLEVLSLAVSIRMVFFLEDVMACTKRLLEWIAGWLPRHCIGAILVSLPALAVYSHVTSEYETNIHFPVFTGSAALIAVVHYCNFCQLSSWMRSSLATVVGAGPLLLLYVSLCPDSSVLTSPLDAVQNFSSERNPCNSSVPRDLRRPASLIGQEVVLVFFLLLLLVWFLNREFEVSYRLHYHGDVEADLHRTKIQSMRDQADWLLRNIIPYHVAEQLKVSQTYSKNHDSGGVIFASIVNFSEFYEENYEGGKECYRVLNELIGDFDELLSKPDYSSIEKIKTIGATYMAASGLNTAQAQDGSHPQEHLQILFEFAKEMMRVVDDFNNNMLWFNFKLRVGFNHGPLTAGVIGTTKLLYDIWGDTVNIASRMDTTGVECRIQVSEESYRVLSKMGYDFDYRGTVNVKGKGQMKTYLYPKCTDHRVIPQHQLSISPDIRVQVDGSIGRSPTDEIANLVPSVQYVDKTSLGSDSSTQAKDAHLSPKRPWKEPVKAEERGRFGKAIEKDDCDETGIEEANELTKLNVSKSV

SEQ ID NO: 2833 - protein, 215 aa, Homo sapiens
  Payload ID: 655;
  Gene Symbol: ADCY9;
  Gene Name: adenylate cyclase 9;
  ENSP ID: ENSP00000460066
  MOD_RES (1)..(1): Any amino acid
XEEVIKNSPVKTFASPTFSSLLDVFLSTTVFLTLSTTCFLKYEAATVPPPPAALAVFSAALLLEVLSLAVSIRMVFFLEDVMACTKRLLEWIAGWLPRHCIGAILVSLPALAVYSHVTSEYETNIHFPVFTGSAALIAVVHYCNFCQLSSWMRSSLATVVGAGPLLLLYVSLCPDSSVLTSPLDAVQNFRRREPCGEGDSKFPFSSQEESCRAGA

SEQ ID NO: 2834 - protein, 72 aa, Homo sapiens
  Payload ID: 655;
  Gene Symbol: ADCY9;
  Gene Name: adenylate cyclase 9;
  ENSP ID: ENSP00000460160
  MOD_RES (1)..(1): Any amino acid
XFDVWSNDVNLANLMEQLGVAGKVHISEATAKYLDDRYEMEDGKVIERLGQSVVADQLKDLPFVRNHICSQI

SEQ ID NO: 2835 - protein, 257 aa, Homo sapiens
  Payload ID: 655;
  Gene Symbol: ADCY9;
  Gene Name: adenylate cyclase 9;
  ENSP ID: ENSP00000461825
IEQFCQEKKEMVNMRVGVHTGTVLCGILGMRRFKFDVWSNDVNLANLMEQLGVAGKVHISEATAKYLDDRYEMEDGKVIERLGQSVVADQLKGLKTYLISGQRAKESRCSCAEALLSGFEVIDGSQVSSGPRGQGTASSGNVSDLAQTVKTFDNLKTCPSCGITFAPKSEAGAEGGAPQNGCQDEHKNSTKVTSSWLLFLSVPLLAHPPKASGGPNPKTQNGLLSPPQEEKLTNSQTSLCEILQEKGRWAGVSLDQS

SEQ ID NO: 2836 - protein, 176 aa, Homo sapiens
  Payload ID: 656;
  Gene Symbol: ADCYAP1;
  Gene Name: adenylate cyclase activating polypeptide 1 (pituitary);
  Uniprot ID:  P18509;
  ENSP ID: ENSP00000411658
MTMCSGARLALLVYGIIMHSSVYSSPAAAGLRFPGIRPEEEAYGEDGNPLPDFDGSEPPGAGSPASAPRAAAAWYRPAGRRDVAHGILNEAYRKVLDQLSAGKHLQSLVARGVGGSLGGGAGDDAEPLSKRHSDGIFTDSYSRYRKQMAVKKYLAAVLGKRYKQRVKNKGRRIAYL

SEQ ID NO: 2837 - protein, 176 aa, Homo sapiens; identical to SEQ ID NO: 2836
  Payload ID: 656;
  Gene Symbol: ADCYAP1;
  Gene Name: adenylate cyclase activating polypeptide 1 (pituitary);
  Uniprot ID:  P18509;
  ENSP ID: ENSP00000462647

SEQ ID NO: 2838 - protein, 468 aa, Homo sapiens
  Payload ID: 657;
  Gene Symbol: ADCYAP1R1;
  Gene Name: adenylate cyclase activating polypeptide 1 (pituitary) receptor type I;
  Uniprot ID:  P41586;
  ENSP ID: ENSP00000306620
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 2839 - protein, 496 aa, Homo sapiens
  Payload ID: 657;
  Gene Symbol: ADCYAP1R1;
  Gene Name: adenylate cyclase activating polypeptide 1 (pituitary) receptor type I;
  Uniprot ID:  P41586;
  ENSP ID: ENSP00000379514
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYFSCVQKCYCKPQRAQQHSCKMSELSTITLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 2840 - protein, 524 aa, Homo sapiens
  Payload ID: 657;
  Gene Symbol: ADCYAP1R1;
  Gene Name: adenylate cyclase activating polypeptide 1 (pituitary) receptor type I;
  ENSP ID: ENSP00000386395
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLTNLSPRVPKKAREDPLPVPSDQHSLPFLSCVQKCYCKPQRAQQHSCKMSELSTITLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 2841 - protein, 447 aa, Homo sapiens
  Payload ID: 657;
  Gene Symbol: ADCYAP1R1;
  Gene Name: adenylate cyclase activating polypeptide 1 (pituitary) receptor type I;
  Uniprot ID:  P41586;
  ENSP ID: ENSP00000387335
MAGVVHVSLAALLLLPMAPAMHSDCIFKKEQAMCLEKIQRANELMGFNDSSPGCPGMWDNITCWKPAHVGEMVLVSCPELFRIFNPDQDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 2842 - protein, 74 aa, Homo sapiens
  Payload ID: 657;
  Gene Symbol: ADCYAP1R1;
  Gene Name: adenylate cyclase activating polypeptide 1 (pituitary) receptor type I;
  ENSP ID: ENSP00000400893
MAGVVHVSLAALLLLPMAPAMHSDCIFKKEQAMCLEKIQRANELMGFNDSSPGCPGMWDNITCWKPAHVGEMVL

SEQ ID NO: 2843 - protein, 147 aa, Homo sapiens
  Payload ID: 657;
  Gene Symbol: ADCYAP1R1;
  Gene Name: adenylate cyclase activating polypeptide 1 (pituitary) receptor type I;
  ENSP ID: ENSP00000416622
  MOD_RES (1)..(1): Any amino acid
XATLRLYFDDTGCWDMNDSTALWWVIKGPVVGSIMVNFVLFIGIIVILVQKLQSPDMGGNESSIYLTNLSPRVPKKAREDPLPVPSDQHSLPFLRLARSTLLLIPLFGIHYTVFAFSPENVSKRERLVFELGLGSFQGFVVAVLYCF

SEQ ID NO: 2844 - protein, 496 aa, Homo sapiens; identical to SEQ ID NO: 2839
  Payload ID: 657;
  Gene Symbol: ADCYAP1R1;
  Gene Name: adenylate cyclase activating polypeptide 1 (pituitary) receptor type I;
  Uniprot ID:  P41586;
  ENSP ID: ENSP00000483721

SEQ ID NO: 2845 - protein, 210 aa, Homo sapiens
  Payload ID: 658;
  Gene Symbol: AK1;
  Gene Name: adenylate kinase 1;
  ENSP ID: ENSP00000223836
MGCCSSSDPRREDDLRAREKLKKTKIIFVVGGPGSGKGTQCEKIVQKYGYTHLSTGDLLRSEVSSGSARGKKLSEIMEKGQLVPLETVLDMLRDAMVAKVNTSKGFLIDGYPREVQQGEEFERRIGQPTLLLYVDAGPETMTQRLLKRGETSGRVDDNEETIKKRLETYYKATEPVIAFYEKRGIVRKVNAEGSVDSVFSQVCTHLDALK

SEQ ID NO: 2846 - protein, 194 aa, Homo sapiens
  Payload ID: 658;
  Gene Symbol: AK1;
  Gene Name: adenylate kinase 1;
  Uniprot ID:  P00568;
  ENSP ID: ENSP00000362249
MEEKLKKTKIIFVVGGPGSGKGTQCEKIVQKYGYTHLSTGDLLRSEVSSGSARGKKLSEIMEKGQLVPLETVLDMLRDAMVAKVNTSKGFLIDGYPREVQQGEEFERRIGQPTLLLYVDAGPETMTQRLLKRGETSGRVDDNEETIKKRLETYYKATEPVIAFYEKRGIVRKVNAEGSVDSVFSQVCTHLDALK

SEQ ID NO: 2847 - protein, 194 aa, Homo sapiens; identical to SEQ ID NO: 2846
  Payload ID: 658;
  Gene Symbol: AK1;
  Gene Name: adenylate kinase 1;
  Uniprot ID:  P00568;
  ENSP ID: ENSP00000362271

SEQ ID NO: 2848 - protein, 135 aa, Homo sapiens
  Payload ID: 658;
  Gene Symbol: AK1;
  Gene Name: adenylate kinase 1;
  ENSP ID: ENSP00000392314
  MOD_RES (1)..(1): Any amino acid
XRKPRSSLWWETVLDMLRDAMVAKVNTSKGFLIDGYPREVQQGEEFERRIGQPTLLLYVDAGPETMTQRLLKRGETSGRVDDNEETIKKRLETYYKATEPVIAFYEKRGIVRKVNAEGSVDSVFSQVCTHLDALK

SEQ ID NO: 2849 - protein, 32 aa, Homo sapiens
  Payload ID: 658;
  Gene Symbol: AK1;
  Gene Name: adenylate kinase 1;
  ENSP ID: ENSP00000448741
MEGAPAVSVPPPGAQHRPGTPEVPLAVGPASD

SEQ ID NO: 2850 - protein, 51 aa, Homo sapiens
  Payload ID: 658;
  Gene Symbol: AK1;
  Gene Name: adenylate kinase 1;
  ENSP ID: ENSP00000449130
EKGQLVPLETVLDMLRDAMVAKVNTSKGFLIDGYPREVQQGEEFERRALRP

SEQ ID NO: 2851 - protein, 239 aa, Homo sapiens
  Payload ID: 659;
  Gene Symbol: AK2;
  Gene Name: adenylate kinase 2;
  Uniprot ID:  P54819;
  ENSP ID: ENSP00000346921
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATCKDLVMFI

SEQ ID NO: 2852 - protein, 232 aa, Homo sapiens
  Payload ID: 659;
  Gene Symbol: AK2;
  Gene Name: adenylate kinase 2;
  Uniprot ID:  P54819;
  ENSP ID: ENSP00000362548
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATS

SEQ ID NO: 2853 - protein, 162 aa, Homo sapiens
  Payload ID: 659;
  Gene Symbol: AK2;
  Gene Name: adenylate kinase 2;
  ENSP ID: ENSP00000446849
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGSIEHRNASASGHVCSDRPTLL

SEQ ID NO: 2854 - protein, 232 aa, Homo sapiens
  Payload ID: 659;
  Gene Symbol: AK2;
  Gene Name: adenylate kinase 2;
  ENSP ID: ENSP00000447082
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATC

SEQ ID NO: 2855 - protein, 190 aa, Homo sapiens
  Payload ID: 659;
  Gene Symbol: AK2;
  Gene Name: adenylate kinase 2;
  ENSP ID: ENSP00000449003
MAPSVPAAEPEYPKGIRAVLLGPPGAGKGTQVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATS

SEQ ID NO: 2856 - protein, 42 aa, Homo sapiens
  Payload ID: 659;
  Gene Symbol: AK2;
  Gene Name: adenylate kinase 2;
  ENSP ID: ENSP00000450008
MAPSVPAAEPEYPKGIRAVLLGPPGAGKGTQLEKLKFEWLVL

SEQ ID NO: 2857 - protein, 133 aa, Homo sapiens
  Payload ID: 659;
  Gene Symbol: AK2;
  Gene Name: adenylate kinase 2;
  ENSP ID: ENSP00000450109
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMADSPQEWPFLPRGVQPSKRAHER

SEQ ID NO: 2858 - protein, 42 aa, Homo sapiens; identical to SEQ ID NO: 2856
  Payload ID: 659;
  Gene Symbol: AK2;
  Gene Name: adenylate kinase 2;
  ENSP ID: ENSP00000486342

SEQ ID NO: 2859 - protein, 133 aa, Homo sapiens; identical to SEQ ID NO: 2857
  Payload ID: 659;
  Gene Symbol: AK2;
  Gene Name: adenylate kinase 2;
  ENSP ID: ENSP00000486507

SEQ ID NO: 2860 - protein, 157 aa, Homo sapiens
  Payload ID: 660;
  Gene Symbol: AK3;
  Gene Name: adenylate kinase 3;
  Uniprot ID:  Q9UIJ7;
  ENSP ID: ENSP00000352948
MTRLALHELKNLTQYSWLLDGFPRTLPQAEALDRAYQIDTVINLNVPFEVIKQRLTARWIHPASGRVYNIEFNPPKTVGIDDLTGEPLIQREDDKPETVIKRLKAYEDQTKPVLEYYQKKGVLETFSGTETNKIWPYVYAFLQTKVPQRSQKASVTP

SEQ ID NO: 2861 - protein, 227 aa, Homo sapiens
  Payload ID: 660;
  Gene Symbol: AK3;
  Gene Name: adenylate kinase 3;
  Uniprot ID:  Q9UIJ7;
  ENSP ID: ENSP00000371230
MGASARLLRAVIMGAPGSGKGTVSSRITTHFELKHLSSGDLLRDNMLRGTEIGVLAKAFIDQGKLIPDDVMTRLALHELKNLTQYSWLLDGFPRTLPQAEALDRAYQIDTVINLNVPFEVIKQRLTARWIHPASGRVYNIEFNPPKTVGIDDLTGEPLIQREDDKPETVIKRLKAYEDQTKPVLEYYQKKGVLETFSGTETNKIWPYVYAFLQTKVPQRSQKASVTP

SEQ ID NO: 2862 - protein, 187 aa, Homo sapiens
  Payload ID: 660;
  Gene Symbol: AK3;
  Gene Name: adenylate kinase 3;
  Uniprot ID:  Q9UIJ7;
  ENSP ID: ENSP00000413933
MGASARLLRAVIMGAPGSGKGTVSSRITTHFELKHLSSGDLLRDNMLRGTGFPRTLPQAEALDRAYQIDTVINLNVPFEVIKQRLTARWIHPASGRVYNIEFNPPKTVGIDDLTGEPLIQREDDKPETVIKRLKAYEDQTKPVLEYYQKKGVLETFSGTETNKIWPYVYAFLQTKVPQRSQKASVTP

SEQ ID NO: 2863 - protein, 157 aa, Homo sapiens; identical to SEQ ID NO: 2860
  Payload ID: 660;
  Gene Symbol: AK3;
  Gene Name: adenylate kinase 3;
  Uniprot ID:  Q9UIJ7;
  ENSP ID: ENSP00000482308

SEQ ID NO: 2864 - protein, 223 aa, Homo sapiens
  Payload ID: 661;
  Gene Symbol: AK4;
  Gene Name: adenylate kinase 4;
  Uniprot ID:  P27144;
  ENSP ID: ENSP00000322175
MASKLLRAVILGPPGSGKGTVCQRIAQNFGLQHLSSGHFLRENIKASTEVGEMAKQYIEKSLLVPDHVITRLMMSELENRRGQHWLLDGFPRTLGQAEALDKICEVDLVISLNIPFETLKDRLSRRWIHPPSGRVYNLDFNPPHVHGIDDVTGEPLVQQEDDKPEAVAARLRQYKDVAKPVIELYKSRGVLHQFSGTETNKIWPYVYTLFSNKITPIQSKEAY

SEQ ID NO: 2865 - protein, 223 aa, Homo sapiens; identical to SEQ ID NO: 2864
  Payload ID: 661;
  Gene Symbol: AK4;
  Gene Name: adenylate kinase 4;
  Uniprot ID:  P27144;
  ENSP ID: ENSP00000378743

SEQ ID NO: 2866 - protein, 223 aa, Homo sapiens; identical to SEQ ID NO: 2864
  Payload ID: 661;
  Gene Symbol: AK4;
  Gene Name: adenylate kinase 4;
  Uniprot ID:  P27144;
  ENSP ID: ENSP00000445912

SEQ ID NO: 2867 - protein, 171 aa, Homo sapiens
  Payload ID: 661;
  Gene Symbol: AK4;
  Gene Name: adenylate kinase 4;
  ENSP ID: ENSP00000448458
MAKQYIEKSLLVPDHVITRLMMSELENRRGQHWLLDGFPRTLGQAEALDKICEVDLVISLNIPFETLKDRLSRRWIHPPSGRVYNLDFNPPHVHGIDDVTGEPLVQQEDDKPEAVAARLRQYKDVAKPVIELYKSRGVLHQFSGTETNKIWPYVYTLFSNKITPIQSKEAY

SEQ ID NO: 2868 - protein, 536 aa, Homo sapiens
  Payload ID: 662;
  Gene Symbol: AK5;
  Gene Name: adenylate kinase 5;
  Uniprot ID:  Q9Y6K8;
  ENSP ID: ENSP00000341430
MCSKPEDPVEYLESCLQKVKELGGCDKVKWDTFVSQEKKTLPPLNGGQSRRSFLRNVMPENSNFPYRRYDRLPPIHQFSIESDTDLSETAELIEEYEVFDPTRPRPKIILVIGGPGSGKGTQSLKIAERYGFQYISVGELLRKKIHSTSSNRKWSLIAKIITTGELAPQETTITEIKQKLMQIPDEEGIVIDGFPRDVAQALSFEDQICTPDLVVFLACANQRLKERLLKRAEQQGRPDDNVKATQRRLMNFKQNAAPLVKYFQEKGLIMTFDADRDEDEVFYDISMAVDNKLFPNKEAAAGSSDLDPSMILDTGEIIDTGSDYEDQGDDQLNVFGEDTMGGFMEDLRKCKIIFIIGGPGSGKGTQCEKLVEKYGFTHLSTGELLREELASESERSKLIRDIMERGDLVPSGIVLELLKEAMVASLGDTRGFLIDGYPREVKQGEEFGRRIGDPQLVICMDCSADTMTNRLLQRSRSSLPVDDTTKTIAKRLEAYYRASIPVIAYYETKTQLHKINAEGTPEDVFLQLCTAIDSIF

SEQ ID NO: 2869 - protein, 562 aa, Homo sapiens
  Payload ID: 662;
  Gene Symbol: AK5;
  Gene Name: adenylate kinase 5;
  Uniprot ID:  Q9Y6K8;
  ENSP ID: ENSP00000346577
MNTNDAKEYLARREIPQLFESLLNGLMCSKPEDPVEYLESCLQKVKELGGCDKVKWDTFVSQEKKTLPPLNGGQSRRSFLRNVMPENSNFPYRRYDRLPPIHQFSIESDTDLSETAELIEEYEVFDPTRPRPKIILVIGGPGSGKGTQSLKIAERYGFQYISVGELLRKKIHSTSSNRKWSLIAKIITTGELAPQETTITEIKQKLMQIPDEEGIVIDGFPRDVAQALSFEDQICTPDLVVFLACANQRLKERLLKRAEQQGRPDDNVKATQRRLMNFKQNAAPLVKYFQEKGLIMTFDADRDEDEVFYDISMAVDNKLFPNKEAAAGSSDLDPSMILDTGEIIDTGSDYEDQGDDQLNVFGEDTMGGFMEDLRKCKIIFIIGGPGSGKGTQCEKLVEKYGFTHLSTGELLREELASESERSKLIRDIMERGDLVPSGIVLELLKEAMVASLGDTRGFLIDGYPREVKQGEEFGRRIGDPQLVICMDCSADTMTNRLLQRSRSSLPVDDTTKTIAKRLEAYYRASIPVIAYYETKTQLHKINAEGTPEDVFLQLCTAIDSIF

SEQ ID NO: 2870 - protein, 77 aa, Homo sapiens
  Payload ID: 662;
  Gene Symbol: AK5;
  Gene Name: adenylate kinase 5;
  ENSP ID: ENSP00000433915
MDCSADTMTNRLLQRSRSSLPVDDTTKTIAKRLEAYYRASIPVIAYYETKTQLHKINAEGTPEDVFLQLCTAIDSIF

SEQ ID NO: 2871 - protein, 176 aa, Homo sapiens
  Payload ID: 662;
  Gene Symbol: AK5;
  Gene Name: adenylate kinase 5;
  ENSP ID: ENSP00000434409
MCSKPEDPVEYLESCLQKVKELGGCDKVKWDTFVSQEKKTLPPLNGGQSRRSFLRNVMPENSNFPYRRYDRLPPIHQFSIESDTDLSETAELIEEYEVFDPTRPRPKIILVIGGPGSGKGTQSLKIAERYGFQYISVGELLRKKIHSTSSNRKWSLIAKIITTGELAPQETTITEI

SEQ ID NO: 2872 - protein, 62 aa, Homo sapiens
  Payload ID: 662;
  Gene Symbol: AK5;
  Gene Name: adenylate kinase 5;
  ENSP ID: ENSP00000436859
  MOD_RES (1)..(1): Any amino acid
XGSDYEDQGDDQLNVFGEDTMGGFMEDLRKCKIIFIIGGPGSGKGAGAACLWTTPPRPSPSA

SEQ ID NO: 2873 - protein, 169 aa, Homo sapiens
  Payload ID: 663;
  Gene Symbol: AK6;
  Gene Name: adenylate kinase 6;
  Uniprot ID:  Q9Y3D8;
  ENSP ID: ENSP00000370197
MCHRKPGTPGVGKTTLGKELASKSGLKYINVGDLAREEQLYDGYDEEYDCPILDEDRVVDELDNQMREGGVIVDYHGCDFFPERWFHIVFVLRTDTNVLYERLETRGYNEKKLTDNIQCEIFQVLYEEATASYKEEIVHQLPSNKPEELENNVDQILKWIEQWIKDHNS

SEQ ID NO: 2874 - protein, 172 aa, Homo sapiens
  Payload ID: 663;
  Gene Symbol: AK6;
  Gene Name: adenylate kinase 6;
  Uniprot ID:  Q9Y3D8;
  ENSP ID: ENSP00000370201
MLLPNILLTGTPGVGKTTLGKELASKSGLKYINVGDLAREEQLYDGYDEEYDCPILDEDRVVDELDNQMREGGVIVDYHGCDFFPERWFHIVFVLRTDTNVLYERLETRGYNEKKLTDNIQCEIFQVLYEEATASYKEEIVHQLPSNKPEELENNVDQILKWIEQWIKDHNS

SEQ ID NO: 2875 - protein, 141 aa, Homo sapiens
  Payload ID: 663;
  Gene Symbol: AK6;
  Gene Name: adenylate kinase 6;
  ENSP ID: ENSP00000420947
MLLPNILLTEQLYDGYDEEYDCPILDEDRVVDELDNQMREGGVIVDYHGCDFFPERWFHIVFVLRTDTNVLYERLETRGYNEKKLTDNIQCEIFQVLYEEATASYKEEIVHQLPSNKPEELENNVDQILKWIEQWIKDHNS

SEQ ID NO: 2876 - protein, 264 aa, Homo sapiens
  Payload ID: 663;
  Gene Symbol: AK6;
  Gene Name: adenylate kinase 6;
  ENSP ID: ENSP00000477611
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKASTSAGRITVPRLSVGSVTSRPSTPTLGTPTPQTMSVSTKVGTPMSLTGQRFTVQMPTSQSPAVKASIPATSAVQNVLINPSLIGSKNILITTNMMSSQNTANESSNALKRKREDDDDDDDDDDDYDNL

SEQ ID NO: 2877 - protein, 264 aa, Homo sapiens; identical to SEQ ID NO: 2876
  Payload ID: 663;
  Gene Symbol: AK6;
  Gene Name: adenylate kinase 6;
  ENSP ID: ENSP00000477750

SEQ ID NO: 2878 - protein, 102 aa, Homo sapiens
  Payload ID: 663;
  Gene Symbol: AK6;
  Gene Name: adenylate kinase 6;
  ENSP ID: ENSP00000478838
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQT

SEQ ID NO: 2879 - protein, 264 aa, Homo sapiens; identical to SEQ ID NO: 2876
  Payload ID: 663;
  Gene Symbol: AK6;
  Gene Name: adenylate kinase 6;
  ENSP ID: ENSP00000478935

SEQ ID NO: 2880 - protein, 109 aa, Homo sapiens
  Payload ID: 663;
  Gene Symbol: AK6;
  Gene Name: adenylate kinase 6;
  ENSP ID: ENSP00000479366
MLLPNILLTGTPGVGKTTLGKELASKSGLKYINVGDLAREEQLYDGYDEEYDCPILDEDRVVDELDNQMREGGVIVDYHGCDFFPERWFHIVFVLRTDTNVLYERLETR

SEQ ID NO: 2881 - protein, 127 aa, Homo sapiens
  Payload ID: 663;
  Gene Symbol: AK6;
  Gene Name: adenylate kinase 6;
  ENSP ID: ENSP00000480119
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNY

SEQ ID NO: 2882 - protein, 197 aa, Homo sapiens
  Payload ID: 663;
  Gene Symbol: AK6;
  Gene Name: adenylate kinase 6;
  ENSP ID: ENSP00000481041
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKASTSAGRITVPRLSVGSVTSRPSTPTLGTPTPQTMSVSTKVGTPMSLTGQRFTVQMPTSQSP

SEQ ID NO: 2883 - protein, 47 aa, Homo sapiens
  Payload ID: 663;
  Gene Symbol: AK6;
  Gene Name: adenylate kinase 6;
  ENSP ID: ENSP00000481620
MLLPNILLTGTPGVGKTTLGKELASKSGLKYINVGDLAREGVIMRRN

SEQ ID NO: 2884 - protein, 135 aa, Homo sapiens
  Payload ID: 663;
  Gene Symbol: AK6;
  Gene Name: adenylate kinase 6;
  ENSP ID: ENSP00000482215
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKK

SEQ ID NO: 2885 - protein, 166 aa, Homo sapiens
  Payload ID: 663;
  Gene Symbol: AK6;
  Gene Name: adenylate kinase 6;
  ENSP ID: ENSP00000483457
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKASTSAGRITVPRLSVGSVTSRPSTPTLGTPT

SEQ ID NO: 2886 - protein, 723 aa, Homo sapiens
  Payload ID: 664;
  Gene Symbol: AK7;
  Gene Name: adenylate kinase 7;
  Uniprot ID:  Q96M32;
  ENSP ID: ENSP00000267584
MAEEEETAALTEKVIRTQRVFINLLDSYSSGNIGKFLSNCVVGASLEEITEEEEEEDENKSAMLEASSTKVKEGTFQIVGTLSKPDSPRPDFAVETYSAISREDLLMRLLECDVIIYNITESSQQMEEAIWAVSALSEEVSHFEKRKLFILLSTVMTWARSKALDPEDSEVPFTEEDYRRRKSHPNFLDHINAEKMVLKFGKKARKFAAYVVAAGLQYGAEGGMLHTFFKMAWLGEIPALPVFGDGTNVIPTIHVLDLAGVIQNVIDHVPKPHYLVAVDESVHTLEDIVKCISKNTGPGKIQKIPRENAYLTKDLTQDCLDHLLVNLRMEALFVKENFNIRWAAQTGFVENINTILKEYKQSRGLMPIKICILGPPAVGKSSIAKELANYYKLHHIQLKDVISEAIAKLEAIVAPNDVGEGEEEVEEEEEEENVEDAQELLDGIKESMEQNAGQLDDQYIIRFMKEKLKSMPCRNQGYILDGFPKTYDQAKDLFNQEDEEEEDDVRGRMFPFDKLIIPEFVCALDASDEFLKERVINLPESIVAGTHYSQDRFLRALSNYRDINIDDETVFNYFDELEIHPIHIDVGKLEDAQNRLAIKQLIKEIGEPRNYGLTDEEKAEEERKAAEERLAREAAEEAEREHQEAVEMAEKIARWEEWNKRLEEVKREERELLEAQSIPLRNYLMTYVMPTLIQGLNECCNVRPEDPVDFLAEYLFKNNPEAQ

SEQ ID NO: 2887 - protein, 152 aa, Homo sapiens
  Payload ID: 664;
  Gene Symbol: AK7;
  Gene Name: adenylate kinase 7;
  ENSP ID: ENSP00000450453
  MOD_RES (1)..(1): Any amino acid
XLLVFKDVGKLEDAQNRLAIKQLIKEIGEPRNYGLTDEEKAEEERKAAEERLAREAAEEAEREHQEAVEMAEKIARWEEWNKRLEEVKREERELLEAQSIPLRNYLMTYVMPTLIQGLNECCNVRPEDPVDFLVGMQWHNLGLLQPPPPGFK

SEQ ID NO: 2888 - protein, 107 aa, Homo sapiens
  Payload ID: 664;
  Gene Symbol: AK7;
  Gene Name: adenylate kinase 7;
  ENSP ID: ENSP00000451068
MAEEEETAALTEKVIRTQRVFINLLDSYSSGNIGKFLSNCVVGASLEEITEEEEEEDENKSAMLEASSTKVKEGTFQIVGTLSKPDSPRPDFAVETYSVSPGGSGQE

SEQ ID NO: 2889 - protein, 479 aa, Homo sapiens
  Payload ID: 665;
  Gene Symbol: AK8;
  Gene Name: adenylate kinase 8;
  Uniprot ID:  Q96MA6;
  ENSP ID: ENSP00000298545
MDATIAPHRIPPEMPQYGEENHIFELMQNMLEQLLIHQPEDPIPFMIQHLHRDNDNVPRIVILGPPASGKTTIAMWLCKHLNSSLLTLENLILNEFSYTATEARRLYLQRKTVPSALLVQLIQERLAEEDCIKQGWILDGIPETREQALRIQTLGITPRHVIVLSAPDTVLIERNLGKRIDPQTGEIYHTTFDWPPESEIQNRLMVPEDISELETAQKLLEYHRNIVRVIPSYPKILKVISADQPCVDVFYQALTYVQSNHRTNAPFTPRVLLLGPVGSGKSLQAALLAQKYRLVNVCCGQLLKEAVADRTTFGELIQPFFEKEMAVPDSLLMKVLSQRLDQQDCIQKGWVLHGVPRDLDQAHLLNRLGYNPNRVFFLNVPFDSIMERLTLRRIDPVTGERYHLMYKPPPTMEIQARLLQNPKDAEEQVKLKMDLFYRNSADLEQLYGSAITLNGDQDPYTVFEYIESGIINPLPKKIP

SEQ ID NO: 2890 - protein, 421 aa, Homo sapiens
  Payload ID: 666;
  Gene Symbol: AK9;
  Gene Name: adenylate kinase 9;
  Uniprot ID:  Q5TCS8;
  ENSP ID: ENSP00000285397
MTSQEKTEEYPFADIFDEDETERNFLLSKPVCFVVFGKPGVGKTTLARYITQAWKCIRVEALPILEEQIAAETESGVMLQSMLISGQSIPDELVIKLMLEKLNSPEVCHFGYIITEIPSLSQDAMTTLQQIELIKNLNLKPDVIINIKCPDYDLCQRISGQRQHNNTGYIYSRDQWDPEVIENHRKKKKEAQKDGKGEEEEEEEEQEEEEAFIAEMQMVAEILHHLVQRPEDYLENVENIVKLYKETILQTLEEVMAEHNPQYLIELNGNKPAEELFMIVMDRLKYLNLKRAAILTKLQGAEEEINDTMENDELFRTLASYKLIAPRYRWQRSKWGRTCPVNLKDGNIYSGLPDYSVSFLGKIYCLSSEEALKPFLLNPRPYLLPPMPGPPCKVFILGPQYSGKTTLCNMLAENYKGKVTN

SEQ ID NO: 2891 - protein, 336 aa, Homo sapiens
  Payload ID: 666;
  Gene Symbol: AK9;
  Gene Name: adenylate kinase 9;
  Uniprot ID:  Q5TCS8;
  ENSP ID: ENSP00000347431
MKERKRHLGDTKHFCPVVLKENFILQPGNTEEAAKYREKIYYFSSAEAKEKFLEHPEDYVAHEEPLKAPPLRICLVGPQGSGKTMCGRQLAEKLNIFHIQFEEVLQEKLLLKTEKKVGPEFEEDSENEQAAKQELEELAIQANVKVEEENTKKQLPEVQLTEEEEVIKSSLMENEPLPPEILEVILSEWWLKEPIRSTGFILDGFPRYPEEAQFLGDRGFFPDAAVFIQVDDQDIFDRLLPAQIEKWKLKQKKKLERKKLIKDMKAKIRVDTIAKRRAELILERDKKRREVSSFVFFFKTGSHSVAQGRVQWHNHSSLQPRTPGLKGSSHLSLSKC

SEQ ID NO: 2892 - protein, 736 aa, Homo sapiens
  Payload ID: 666;
  Gene Symbol: AK9;
  Gene Name: adenylate kinase 9;
  ENSP ID: ENSP00000357944
MTSQEKTEEYPFADIFDEDETERNFLLSKPVCFVVFGKPGVGKTTLARYITQAWKCIRVEALPILEEQIAAETESGVMLQSMLISGQSIPDELVIKLMLEKLNSPEVCHFGYIITEIPSLSQDAMTTLQQIELIKNLNLKPDVIINIKCPDYDLCQRISGQRQHNNTGYIYSRDQWDPEVIENHRKKKKEAQKDGKGEEEEEEEEQEEEEAFIAEMQMVAEILHHLVQRPEDYLENVENIVKLYKETILQTLEEVMAEHNPQYLIELNGNKPAEELFMIVMDRLKYLNLKRAAILTKLQGAEEEINDTMENDELFRTLASYKLIAPRYRWQRSKWGRTCPVNLKDGNIYSGLPDYSVSFLGKIYCLSSEEALKPFLLNPRPYLLPPMPGPPCKVFILGPQYSGKTTLCNMLAENYKGKVVDYAQLVQPRFDKARETLVENTIAEATAAAIKVVKEKLLRELQARKQAETALREFQRQYEKMEFGVFPMEATHSSIDEEGYIQGSQRDRGSSLVDTEEAKTKSENVLHDQAAKVDKDDGKETGETFTFKRHSQDASQDVKLYSDTAPTEDLIEEVTADHPEVVTMIEETIKMSQDINFEQPYEKHAEILQEVLGEVMEENKDRFPGAPKYGGWIVDNCPIVKELWMALIKKGIIPDLVIYLSDTENNGKCLFNRIYLQKKSEIDSKILERLLEELQKKKKEEEEARKATEEELRLEEENRRLLELMKVKAKGKHRLL

SEQ ID NO: 2893 - protein, 227 aa, Homo sapiens
  Payload ID: 666;
  Gene Symbol: AK9;
  Gene Name: adenylate kinase 9;
  ENSP ID: ENSP00000407510
MLQSMLISGQSIPDELVIKLMLEKLNSPEVCHFGYIITEIPSLSQDAMTTLQQIELIKNLNLKPDVIINIKCPDYDLCQRISGQRQHNNTGYIYSRDQWDPEVIENHRKKKKEAQKDGKGEEEEEEEEQEEEEAFIAEMQMVAEILHHLVQRPEDYLENVENIVKLYKETILQTLEEVMAEHNPQYLIELNGNKPAEELFMIVMDRLKYLNLKRAAILTKLQGAEEE

SEQ ID NO: 2894 - protein, 1911 aa, Homo sapiens [sequence omitted]

SEQ ID NO: 2895 - protein, 218 aa, Homo sapiens
  Payload ID: 666;
  Gene Symbol: AK9;
  Gene Name: adenylate kinase 9;
  ENSP ID: ENSP00000418670
  MOD_RES (1)..(1): Any amino acid
XVEEENTKKQLPEVQLTEEEEVIKSSLMENEPLPPEILEVILSEWWLKEPIRSTGFILDGFPRYPEEAQFLGDRGFFPDAAVFIQVDDQDIFDRLLPAQIEKWKLKQKKKLERKKLIKDMKAKIRVDTIAKRRAELILERDKKRREPNKEKRKRGISENTTCYKCNHMSPWCEYAGLPYRGLLILYSATATATAGTKHCRSGAKVIVALSKQNIHNQK

SEQ ID NO: 2896 - protein, 749 aa, Homo sapiens
  Payload ID: 666;
  Gene Symbol: AK9;
  Gene Name: adenylate kinase 9;
  ENSP ID: ENSP00000418771
  MOD_RES (1)..(1): Any amino acid
XQIEKWKLKQKKKLERKKLIKDMKAKIRVDTIAKRRAELILERDKKRRENVVRDDEEISEEELEEDNDDIENILEDEFPKDEEEMSGEEDEEQETDAIERLRGELGEKFEADTHNLQIIQDELERYLIPIISINGARRNHIVQYTLNMKLKPLVENRASIFEKCHPIPAPLAQKMLTFTYKYISSFGYWDPVKLSEGETIKPVENAENPIYPVIHRQYIYFLSSKETKEKFMKNPIKYIRQPKPKPTVPIRIIIVGPPKSGKTTVAKKITSEYGLKHLSIGGALRYVLNNHPETELALMLNWHLHKGMTAPDELAIQALELSLMESVCNTAGVVIDGYPVTKHQMNLLEARSIIPMVIFELSVPSKEIFKRLLLEKENEQRLPYPLHNSAQIVAVNNVKYRKNIGEIRQYYQEQHQNWYVIDGFHSKWWVWNEVIKNVQMVNKYMQTYLERIKAGKAACIDKLCITPQELLSRLGEFEQFCPVSLAESQELFDCSATDSLEFAAEFRGHYYKMSSQEKLNKFLENPELYVPPLAPHPLPSADMIPKRLTLSELKSRFPKCAELQGYCPVTYKDGNQRYEALVPGSINYALEYHNRIYICENKEKLQKFLRSPLKYWEQKLPHKLPPLREPILLTSLPLPGYLEQGIATSLIKAMNAAGCLKPKFPFLSIRRSALLYIALHLKAFNPKGSEYTRKKYKKKMEQFMESCELITYLGAKMTRKYKEPQFRAIDFDHKLKTFLSLRNIDPING

SEQ ID NO: 2897 - protein, 312 aa, Homo sapiens
  Payload ID: 666;
  Gene Symbol: AK9;
  Gene Name: adenylate kinase 9;
  ENSP ID: ENSP00000419758
  MOD_RES (1)..(1): Any amino acid
XHSKWWVWNEVIKNVQMVNKYMQTYLERIKAELLSRLGEFEQFCPVSLAESQELFDCSATDSLEFAAEFRGHYYKMSSQEKLNKFLENPELYVPPLAPHPLPSADMIPKRLTLSELKSRFPKCAELQGYCPVTYKDGNQRYEALVPGSINYALEYHNRIYICENKEKLQKFLRSPLKYWEQKLPHKLPPLREPILLTSLPLPGYLEQGIATSLIKAMNAAGCLKPKFPFLSIRRSALLYIALHLKAFNPKGSEYTRKKYKKKMEQFMESCELITYLGAKMTRKYKEPQFRAIDFDHKLKTFLSLRNIDPING

SEQ ID NO: 2898 - protein, 192 aa, Homo sapiens
  Payload ID: 666;
  Gene Symbol: AK9;
  Gene Name: adenylate kinase 9;
  ENSP ID: ENSP00000431394
  MOD_RES (1)..(1): Any amino acid
XITEIPSLSQDAMTTLQQIELIKNLNLKPDVIINIKCPDYDLCQRISGQRQHNNTGYIYSRDQWDPEVIENHRKKKKEAQKDGKGEEEEEEEEQEEEEAFIAEMQMVAEILHHLVQRPEDYLENVENIVKLYKETILQTLEEVMAEHNPQYLIELNGNKPAEELFMDELFRTLASYKLIAPRYRWQRSKWGR

SEQ ID NO: 2899 - protein, 259 aa, Homo sapiens
  Payload ID: 666;
  Gene Symbol: AK9;
  Gene Name: adenylate kinase 9;
  ENSP ID: ENSP00000436325
MTSQEKTEEYPFADIFDEDETERNFLLSKPVCFVVFGKPGVGKTTLARYITQAWKCIRVEALPILEEQIAAETESGVMLQSMLISGQSIPDELVIKLMLEKLNSPEVCHFGYIITEIPSLSQDAMTTLQQIELIKNLNLKPDVIINIKCPDYDLCQRISGQRQHNNTGYIYSRDQWDPEVIENHRKKKKEAQKDGKGEEEEEEEEQEEEEAFIAEMQMVAEILHHLVQRPEDYLENVENIVKLYKETILQTLEEVMAEH

SEQ ID NO: 2900 - protein, 137 aa, Homo sapiens
  Payload ID: 666;
  Gene Symbol: AK9;
  Gene Name: adenylate kinase 9;
  ENSP ID: ENSP00000475585
  MOD_RES (1)..(1): Any amino acid
XEVIENHRKKKKEAQKDGKGEEEEEEEEQEEEEAFIAEMQMVAEILHHLVQRPEDYLENVENIVKLYKETILQTLEEVMAEHNPQYLIELNGNKPAEELFMVSAVLSRNTSQHGKFKSIDSIVLLLINRSIFIFEHH

SEQ ID NO: 2901 - protein, 498 aa, Homo sapiens
  Payload ID: 667;
  Gene Symbol: ADSL;
  Gene Name: adenylosuccinate lyase;
  ENSP ID: ENSP00000216194
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTSLILSRGVIKAYCNLRLPGSDSSPVSVSQLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 2902 - protein, 425 aa, Homo sapiens
  Payload ID: 667;
  Gene Symbol: ADSL;
  Gene Name: adenylosuccinate lyase;
  Uniprot ID:  P30566;
  ENSP ID: ENSP00000341429
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQVQRFLEEEVYPLLKPYESVMKVKAELCL

SEQ ID NO: 2903 - protein, 127 aa, Homo sapiens
  Payload ID: 667;
  Gene Symbol: ADSL;
  Gene Name: adenylosuccinate lyase;
  ENSP ID: ENSP00000485073
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTVGACVVYT

SEQ ID NO: 2904 - protein, 81 aa, Homo sapiens
  Payload ID: 667;
  Gene Symbol: ADSL;
  Gene Name: adenylosuccinate lyase;
  ENSP ID: ENSP00000485202
  MOD_RES (1)..(1): Any amino acid
XRIQVDAYFSPIHSQLDHLLDPSSFTGRASQQCKQVPLDKNVVCVIPCCISNSKSTSDTWQLGSLPASATAPDFLVAWIYS

SEQ ID NO: 2905 - protein, 164 aa, Homo sapiens
  Payload ID: 667;
  Gene Symbol: ADSL;
  Gene Name: adenylosuccinate lyase;
  ENSP ID: ENSP00000485286
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKACTADHSWETLLSLDSGSLHGSPELEACPR

SEQ ID NO: 2906 - protein, 262 aa, Homo sapiens
  Payload ID: 667;
  Gene Symbol: ADSL;
  Gene Name: adenylosuccinate lyase;
  ENSP ID: ENSP00000485288
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKE

SEQ ID NO: 2907 - protein, 360 aa, Homo sapiens
  Payload ID: 667;
  Gene Symbol: ADSL;
  Gene Name: adenylosuccinate lyase;
  ENSP ID: ENSP00000485289
  MOD_RES (1)..(1): Any amino acid
XISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRSVAQGHHIHQVEWRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELC

SEQ ID NO: 2908 - protein, 149 aa, Homo sapiens
  Payload ID: 667;
  Gene Symbol: ADSL;
  Gene Name: adenylosuccinate lyase;
  ENSP ID: ENSP00000485437
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTACTADHSWETLLSLDSGSLHGSPELEACPR

SEQ ID NO: 2909 - protein, 102 aa, Homo sapiens
  Payload ID: 667;
  Gene Symbol: ADSL;
  Gene Name: adenylosuccinate lyase;
  ENSP ID: ENSP00000485443
  MOD_RES (1)..(1): Any amino acid
XRIQVDAYFSPIHSQLDHLLDPSSFTGRASQQVQRFLEEEVYPLLKPYESVMKCKQVPLDKNVVCVIPCCISNSKSTSDTWQLGSLPASATAPDFLVAWIYS

SEQ ID NO: 2910 - protein, 78 aa, Homo sapiens
  Payload ID: 667;
  Gene Symbol: ADSL;
  Gene Name: adenylosuccinate lyase;
  ENSP ID: ENSP00000485462
  MOD_RES (1)..(1): Any amino acid
XGVKGTTGTQASFLQLFEGDDHKVEQLDKMVTEKAGFKRAFIITGQTYTRKVDIEVLSVLASLGASVHKSFGNREESE

SEQ ID NO: 2911 - protein, 133 aa, Homo sapiens
  Payload ID: 667;
  Gene Symbol: ADSL;
  Gene Name: adenylosuccinate lyase;
  ENSP ID: ENSP00000485477
MDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMT

SEQ ID NO: 2912 - protein, 484 aa, Homo sapiens
  Payload ID: 667;
  Gene Symbol: ADSL;
  Gene Name: adenylosuccinate lyase;
  Uniprot ID:  P30566;
  ENSP ID: ENSP00000485525
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 2913 - protein, 456 aa, Homo sapiens
  Payload ID: 668;
  Gene Symbol: ADSS;
  Gene Name: adenylosuccinate synthase;
  Uniprot ID:  P30520;
  ENSP ID: ENSP00000355493
MAFAETYPAASSLPNGDCGRPRARPGGNRVTVVLGAQWGDEGKGKVVDLLAQDADIVCRCQGGNNAGHTVVVDSVEYDFHLLPSGIINPNVTAFIGNGVVIHLPGLFEEAEKNVQKGKGLEGWEKRLIISDRAHIVFDFHQAADGIQEQQRQEQAGKNLGTTKKGIGPVYSSKAARSGLRMCDLVSDFDGFSERFKVLANQYKSIYPTLEIDIEGELQKLKGYMEKIKPMVRDGVYFLYEALHGPPKKILVEGANAALLDIDFGTYPFVTSSNCTVGGVCTGLGMPPQNVGEVYGVVKAYTTRVGIGAFPTEQDNEIGELLQTRGREFGVTTGRKRRCGWLDLVLLKYAHMINGFTALALTKLDILDMFTEIKVGVAYKLDGEIIPHIPANQEVLNKVEVQYKTLPGWNTDISNARAFKELPVNAQNYVRFIEDELQIPVKWIGVGKSRESMIQLF

SEQ ID NO: 2914 - protein, 457 aa, Homo sapiens
  Payload ID: 669;
  Gene Symbol: ADSSL1;
  Gene Name: adenylosuccinate synthase like 1;
  Uniprot ID:  Q8N142;
  ENSP ID: ENSP00000331260
MSGTRASNDRPPGAGGVKRGRLQQEAAATGSRVTVVLGAQWGDEGKGKVVDLLATDADIISRCQGGNNAGHTVVVDGKEYDFHLLPSGIINTKAVSFIGNGVVIHLPGLFEEAEKNEKKGLKDWEKRLIISDRAHLVFDFHQAVDGLQEVQRQAQEGKNIGTTKKGIGPTYSSKAARTGLRICDLLSDFDEFSSRFKNLAHQHQSMFPTLEIDIEGQLKRLKGFAERIRPMVRDGVYFMYEALHGPPKKILVEGANAALLDIDFGTYPFVTSSNCTVGGVCTGLGIPPQNIGDVYGVVKAYTTRVGIGAFPTEQINEIGGLLQTRGHEWGVTTGRKRRCGWLDLMILRYAHMVNGFTALALTKLDILDVLGEVKVGVSYKLNGKRIPYFPANQEMLQKVEVEYETLPGWKADTTGARRWEDLPPQAQNYIRFVENHVGVAVKWVGVGKSRESMIQLF

SEQ ID NO: 2915 - protein, 500 aa, Homo sapiens
  Payload ID: 669;
  Gene Symbol: ADSSL1;
  Gene Name: adenylosuccinate synthase like 1;
  Uniprot ID:  Q8N142;
  ENSP ID: ENSP00000333019
MVGRSCGVATQRQGGGQRPTNLALTLSSSPAHSTALPWLPPRSLQLLSGHSVPAQPTPHLPSACGGPTRVTLGEERAWRSHGSNAGGHTCLPRRTAGAGSLTPGGERGGNNAGHTVVVDGKEYDFHLLPSGIINTKAVSFIGNGVVIHLPGLFEEAEKNEKKGLKDWEKRLIISDRAHLVFDFHQAVDGLQEVQRQAQEGKNIGTTKKGIGPTYSSKAARTGLRICDLLSDFDEFSSRFKNLAHQHQSMFPTLEIDIEGQLKRLKGFAERIRPMVRDGVYFMYEALHGPPKKILVEGANAALLDIDFGTYPFVTSSNCTVGGVCTGLGIPPQNIGDVYGVVKAYTTRVGIGAFPTEQINEIGGLLQTRGHEWGVTTGRKRRCGWLDLMILRYAHMVNGFTALALTKLDILDVLGEVKVGVSYKLNGKRIPYFPANQEMLQKVEVEYETLPGWKADTTGARRWEDLPPQAQNYIRFVENHVGVAVKWVGVGKSRESMIQLF

SEQ ID NO: 2916 - protein, 74 aa, Homo sapiens
  Payload ID: 669;
  Gene Symbol: ADSSL1;
  Gene Name: adenylosuccinate synthase like 1;
  ENSP ID: ENSP00000450433
MLQKVEVEYETLPGWKADTTGARRWEDLPPQAQNYIRFVENHVGVAVCIITVFSALSVKWVGVGKSRESMIQLF

SEQ ID NO: 2917 - protein, 226 aa, Homo sapiens
  Payload ID: 669;
  Gene Symbol: ADSSL1;
  Gene Name: adenylosuccinate synthase like 1;
  ENSP ID: ENSP00000450759
MVGRSCGVATQRQGGGQRPTNLALTLSSSPAHSTALPWLPPRSLQLLSGHSVPAQPTPHLPSACGGPTRVTLGEERAWRSHGSNAGGHTCLPRRTAGAGSLTPGGERGGNNAGHTVVVDGKEYDFHLLPSGIINTKAVSFIGNGVVIHLPGLFEEAEKNEKKGLKDWEKRLIISDRAHLGCRRTSGSAAPGTRGEEYRHHQEGNRTNLLFQSCPDRPPHLRPPVRF

SEQ ID NO: 2918 - protein, 63 aa, Homo sapiens
  Payload ID: 669;
  Gene Symbol: ADSSL1;
  Gene Name: adenylosuccinate synthase like 1;
  ENSP ID: ENSP00000452303
MLQKVEVEYETLPGWKADTTGARRWEDLPPQAQNYIRFVENHVGVAVKWVGVGKSRESMIQLF

SEQ ID NO: 2919 - protein, 181 aa, Homo sapiens
  Payload ID: 669;
  Gene Symbol: ADSSL1;
  Gene Name: adenylosuccinate synthase like 1;
  ENSP ID: ENSP00000473778
GVVGRSVASASWGGAWRRRRGEERGVGVVGRSVASASWGGAWRRRRGEERGVGMGGNNAGHTVVVDGKEYDFHLLPSGIINTKAVSFIGNGVVIHLPGLFEEAEKNEKKGLKDWEKRLIISDRAHLGDSGQQEVRSMYTHLSSASLLSPAALTWPARQCLIFTRLSTDFRKCSARHKRGRI

SEQ ID NO: 2920 - protein, 411 aa, Homo sapiens
  Payload ID: 670;
  Gene Symbol: AJAP1;
  Gene Name: adherens junctions associated prt 1;
  Uniprot ID:  Q9UKB5;
  ENSP ID: ENSP00000367432
MWIQQLLGLSSMSIRWPGRPLGSHAWILIAMFQLAVDLPACEALGPGPEFWLLPRSPPRPPRLWSFRSGQPARVPAPVWSPRPPRVERIHGQMQMPRARRAHRPRDQAAALVPKAGLAKPPAAAKSSPSLASSSSSSSSAVAGGAPEQQALLRRGKRHLQGDGLSSFDSRGSRPTTETEFIAWGPTGDEEALESNTFPGVYGPTTVSILQTRKTTVAATTTTTTTATPMTLQTKGFTESLDPRRRIPGGVSTTEPSTSPSNNGEVTQPPRILGEASGLAVHQIITITVSLIMVIAALITTLVLKNCCAQSGNTRRNSHQRKTNQQEESCQNLTDFPSARVPSSLDIFTAYNETLQCSHECVRASVPVYTDETLHSTTGEYKSTFNGNRPSSSDRHLIPVAFVSEKWFEISC

SEQ ID NO: 2921 - protein, 411 aa, Homo sapiens; identical to SEQ ID NO: 2920
  Payload ID: 670;
  Gene Symbol: AJAP1;
  Gene Name: adherens junctions associated prt 1;
  Uniprot ID:  Q9UKB5;
  ENSP ID: ENSP00000367433

SEQ ID NO: 2922 - protein, 463 aa, Homo sapiens
  Payload ID: 671;
  Gene Symbol: ADGRA1;
  Gene Name: adhesion G prt-coupled receptor A1;
  Uniprot ID:  Q86SQ6;
  ENSP ID: ENSP00000376383
MLWIGVTARNIYKQVTKKAPLCLDTDQPPYPRQPLLRFYLVSGGVPFIICGVTAATNIRNYGTEDEDTAYCWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTV

SEQ ID NO: 2923 - protein, 560 aa, Homo sapiens
  Payload ID: 671;
  Gene Symbol: ADGRA1;
  Gene Name: adhesion G prt-coupled receptor A1;
  Uniprot ID:  Q86SQ6;
  ENSP ID: ENSP00000376384
MDLKTVLSLPRYPGEFLHPVVYACTAVMLLCLLASFVTYIVHQSAIRISRKGRHTLLNFCFHAALTFTVFAGGINRTKYPILCQAVGIVLHYSTLSTMLWIGVTARNIYKQVTKKAPLCLDTDQPPYPRQPLLRFYLVSGGVPFIICGVTAATNIRNYGTEDEDTAYCWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTV

SEQ ID NO: 2924 - protein, 1279 aa, Homo sapiens
  Payload ID: 671;
  Gene Symbol: ADGRA1;
  Gene Name: adhesion G prt-coupled receptor A1;
  Uniprot ID:  Q86SQ6;
  ENSP ID: ENSP00000475778
MRGHGNHSRLKSRCASLGNVHHHQAQMAHGAHCRGGRTPQSPDSRGPTAGGHTRGRWTYRPIEALINVSFPGAKGGRTAEGEPSWAWVFRSGYLQRQALPGLPVSTRVAACWWQHHPGRDSGFLGPGFIDLLREEPSGRADGKAAAQKTGRLYLFPTFLGNKLPEAADSFGEIASGNSVIFTSVLQSSHPPGTPPPSARKPSPGAAMLVCEETLELGAQGCWGSTSPRGQAVSLVGGPTAGGSRLGGAGCTMGLLMALQARRPRDGTWADPRRCSRAVEGSGLTRAALVSPGPSGVEEDTRREGCVLVGSWRSSTHRSRVLIINTPSGRTPWSQGSLGSTGRYNQTRAPGSQQQGLCSDAALHEDFVPEPTPAFFQYPPQAFSKTKVRDLGRGGLYAFSKEEKVSEAQRVEAYETHGLGLSTGRQNPVPSPCKPGCVCQGLALDAEAWPRHPGRRPCAAKEACLGPPGCSGELSLPEEEGIAPGAATAAPAWVPHGRVSRFLTVKLFTYVTMYQCKQERILRLCISGESGRYVRRSRFRNFAALMVSTGVPGVLQLGARPLRGGGHPYGDSQAGKVVEWRAGDRASGLSAGERRFLSQSELQTWPRTPHCVGKKVPQPVGAADLAPDTSLCRKEGSSASRSCRPGPGHLTRREEDSFRQLAFPRFEEVTFPPLTAAERAPSVHGGHSLASQGLVLAGRTRSVASGGKQELSGPLAACIPTQDLKTVLSLPRYPGEFLHPVVYACTAVMLLCLLASFVTYIVHQSAIRISRKGRHTLLNFCFHAALTFTVFAGGINRTKYPILCQAVGIVLHYSTLSTMLWIGVTARNIYKQVTKKAPLCLDTDQPPYPRQPLLRFYLVSGGVPFIICGVTAATNIRNYGTEDEDTACWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTV

SEQ ID NO: 2925 - protein, 1121 aa, Homo sapiens
  Payload ID: 672;
  Gene Symbol: ADGRA2;
  Gene Name: adhesion G prt-coupled receptor A2;
  Uniprot ID:  Q96PE1;
  ENSP ID: ENSP00000323508
MGAGGRRMRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRFYLIAGGIPLIICGITAAVNIHNYRDHSPYCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQLGALVTTHFLYLAMWACGALAVSQRWLPRVVCSCLYGVAASALGLFVFTHHCARRRDVRASWRACCPPASPAAPHAPPRALPAAAEDGSPVFGEGPPSLKSSPSGSSGHPLALGPCKLTNLQLAQSQVCEAGAAAGGEGEPEPAGTRGNLAHRHPNNVHHGRRAHKSRAKGHRAGEACGKNRLKALRGGAAGALELLSSESGSLHNSPTDSYLGSSRNSPGAGLQLEGEPMLTPSEGSDTSAAPLSEAGRAGQRRSASRDSLKGGGALEKESHRRSYPLNAASLNGAPKGGKYDDVTLMGAEVASGGCMKTGLWKSETTV

SEQ ID NO: 2926 - protein, 190 aa, Homo sapiens
  Payload ID: 672;
  Gene Symbol: ADGRA2;
  Gene Name: adhesion G prt-coupled receptor A2;
  ENSP ID: ENSP00000400860
RAAVQGLEPRPAHLSLGCVAAFLYWFPREHLLHGGKGKVPSYLGCLGLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSL

SEQ ID NO: 2927 - protein, 1338 aa, Homo sapiens
  Payload ID: 672;
  Gene Symbol: ADGRA2;
  Gene Name: adhesion G prt-coupled receptor A2;
  Uniprot ID:  Q96PE1;
  ENSP ID: ENSP00000406367
MGAGGRRMRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVNARNVALEAYLIKPHSYVGLTCTAFQRREGGVPGTRPGSPGQNPPPEPEPPADQQLRFRCTTGRPNVSLSSFHIKNSVALASIQLPPSLFSSLPAALAPPVPPDCTLQLLVFRNGRLFHSHSNTSRPGAAGPGKRRGVATPVIFAGTSGCGVGNLTEPVAVSLRHWAEGAEPVAAWWSQEGPGEAGGWTSEGCQLRSSQPNVSALHCQHLGNVAVLMELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRFYLIAGGIPLIICGITAAVNIHNYRDHSPYCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQLGALVTTHFLYLAMWACGALAVSQRWLPRVVCSCLYGVAASALGLFVFTHHCARRRDVRASWRACCPPASPAAPHAPPRALPAAAEDGSPVFGEGPPSLKSSPSGSSGHPLALGPCKLTNLQLAQSQVCEAGAAAGGEGEPEPAGTRGNLAHRHPNNVHHGRRAHKSRAKGHRAGEACGKNRLKALRGGAAGALELLSSESGSLHNSPTDSYLGSSRNSPGAGLQLEGEPMLTPSEGSDTSAAPLSEAGRAGQRRSASRDSLKGGGALEKESHRRSYPLNAASLNGAPKGGKYDDVTLMGAEVASGGCMKTGLWKSETTV

SEQ ID NO: 2928 - protein, 1321 aa, Homo sapiens
  Payload ID: 673;
  Gene Symbol: ADGRA3;
  Gene Name: adhesion G prt-coupled receptor A3;
  Uniprot ID:  Q8IWK6;
  ENSP ID: ENSP00000334952
MEPPGRRRGRAQPPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKNTIVEASIQLPPSLFSPKQKRELRPTDDSLYKLQLIAFRNGKLFPATGNSTNLADDGKRRTVVTPVILTKIDGVNVDTHHIPVNVTLRRIAHGADAVAARWDFDLLNGQGGWKSDGCHILYSDENITTIQCYSLSNYAVLMDLTGSELYTQAASLLHPVVYTTAIILLLCLLAVIVSYIYHHSLIRISLKSWHMLVNLCFHIFLTCVVFVGGITQTRNASICQAVGIILHYSTLATVLWVGVTARNIYKQVTKKAKRCQDPDEPPPPPRPMLRFYLIGGGIPIIVCGITAAANIKNYGSRPNAPYCWMAWEPSLGAFYGPASFITFVNCMYFLSIFIQLKRHPERKYELKEPTEEQQRLAANENGEINHQDSMSLSLISTSALENEHTFHSQLLGASLTLLLYVALWMFGALAVSLYYPLDLVFSFVFGATSLSFSAFFVVHHCVNREDVRLAWIMTCCPGRSSYSVQVNVQPPNSNGTNGEAPKCPNSSAESSCTNKSASSFKNSSQGCKLTNLQAAAAQCHANSLPLNSTPQLDNSLTEHSMDNDIKMHVAPLEVQFRTNVHSSRHHKNRSKGHRASRLTVLREYAYDVPTSVEGSVQNGLPKSRLGNNEGHSRSRRAYLAYRERQYNPPQQDSSDACSTLPKSSRNFEKPVSTTSKKDALRKPAVVELENQQKSYGLNLAIQNGPIKSNGQEGPLLGTDSTGNVRTGLWKHETTV

SEQ ID NO: 2929 - protein, 616 aa, Homo sapiens
  Payload ID: 673;
  Gene Symbol: ADGRA3;
  Gene Name: adhesion G prt-coupled receptor A3;
  Uniprot ID:  Q8IWK6;
  ENSP ID: ENSP00000421006
MEPPGRRRGRAQPPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKVCYILQSFKTIYS

SEQ ID NO: 2930 - protein, 381 aa, Homo sapiens
  Payload ID: 673;
  Gene Symbol: ADGRA3;
  Gene Name: adhesion G prt-coupled receptor A3;
  Uniprot ID:  Q8IWK6;
  ENSP ID: ENSP00000422606
MPLKRNNSKYPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKGKFR

SEQ ID NO: 2931 - protein, 34 aa, Homo sapiens
  Payload ID: 673;
  Gene Symbol: ADGRA3;
  Gene Name: adhesion G prt-coupled receptor A3;
  ENSP ID: ENSP00000424927
MLRFYLIGGGIPIIVCGITAAANIKNYGSRPNAP

SEQ ID NO: 2932 - protein, 97 aa, Homo sapiens
  Payload ID: 673;
  Gene Symbol: ADGRA3;
  Gene Name: adhesion G prt-coupled receptor A3;
  ENSP ID: ENSP00000425223
MASYIDQDMQVLWYQDGRIVETDESQGIFVEKNMIHNCSLIASALTISNIQAGSTGNWGCHVQTKRGNNTRTVDIVVLESSAQYCPPERVVNNKGDF

SEQ ID NO: 2933 - protein, 1584 aa, Homo sapiens
  Payload ID: 674;
  Gene Symbol: ADGRB1;
  Gene Name: adhesion G prt-coupled receptor B1;
  Uniprot ID:  O14514;
  ENSP ID: ENSP00000313046
MRGQAAAPGPVWILAPLLLLLLLLGRRARAAAGADAGPGPEPCATLVQGKFFGYFSAAAVFPANASRCSWTLRNPDPRRYTLYMKVAKAPVPCSGPGRVRTYQFDSFLESTRTYLGVESFDEVLRLCDPSAPLAFLQASKQFLQMRRQQPPQHDGLRPRAGPPGPTDDFSVEYLVVGNRNPSRAACQMLCRWLDACLAGSRSSHPCGIMQTPCACLGGEAGGPAAGPLAPRGDVCLRDAVAGGPENCLTSLTQDRGGHGATGGWKLWSLWGECTRDCGGGLQTRTRTCLPAPGVEGGGCEGVLEEGRQCNREACGPAGRTSSRSQSLRSTDARRREELGDELQQFGFPAPQTGDPAAEEWSPWSVCSSTCGEGWQTRTRFCVSSSYSTQCSGPLREQRLCNNSAVCPVHGAWDEWSPWSLCSSTCGRGFRDRTRTCRPPQFGGNPCEGPEKQTKFCNIALCPGRAVDGNWNEWSSWSACSASCSQGRQQRTRECNGPSYGGAECQGHWVETRDCFLQQCPVDGKWQAWASWGSCSVTCGAGSQRRERVCSGPFFGGAACQGPQDEYRQCGTQRCPEPHEICDEDNFGAVIWKETPAGEVAAVRCPRNATGLILRRCELDEEGIAYWEPPTYIRCVSIDYRNIQMMTREHLAKAQRGLPGEGVSEVIQTLVEISQDGTSYSGDLLSTIDVLRNMTEIFRRAYYSPTPGDVQNFVQILSNLLAEENRDKWEEAQLAGPNAKELFRLVEDFVDVIGFRMKDLRDAYQVTDNLVLSIHKLPASGATDISFPMKGWRATGDWAKVPEDRVTVSKSVFSTGLTEADEASVFVVGTVLYRNLGSFLALQRNTTVLNSKVISVTVKPPPRSLRTPLEIEFAHMYNGTTNQTCILWDETDVPSSSAPPQLGPWSWRGCRTVPLDALRTRCLCDRLSTFAILAQLSADANMEKATLPSVTLIVGCGVSSLTLLMLVIIYVSVWRYIRSERSVILINFCLSIISSNALILIGQTQTRNKVVCTLVAAFLHFFFLSSFCWVLTEAWQSYMAVTGHLRNRLIRKRFLCLGWGLPALVVAISVGFTKAKGYSTMNYCWLSLEGGLLYAFVGPAAAVVLVNMVIGILVFNKLVSKDGITDKKLKERAGASLWSSCVVLPLLALTWMSAVLAVTDRRSALFQILFAVFDSLEGFVIVMVHCILRREVQDAVKCRVVDRQEEGNGDSGGSFQNGHAQLMTDFEKDVDLACRSVLNKDIAACRTATITGTLKRPSLPEEEKLKLAHAKGPPTNFNSLPANVSKLHLHGSPRYPGGPLPDFPNHSLTLKRDKAPKSSFVGDGDIFKKLDSELSRAQEKALDTSYVILPTATATLRPKPKEEPKYSIHIDQMPQTRLIHLSTAPEASLPARSPPSRQPPSGGPPEAPPAQPPPPPPPPPPPPQQPLPPPPNLEPAPPSLGDPGEPAAHPGPSTGPSTKNENVATLSVSSLERRKSRYAELDFEKIMHTRKRHQDMFQDLNRKLQHAAEKDKEVLGPDSKPEKQQTPNKRPWESLRKAHGTPTWVKKELEPLQPSPLELRSVEWERSGATIPLVGQDIIDLQTEV

SEQ ID NO: 2934 - protein, 1159 aa, Homo sapiens
  Payload ID: 674;
  Gene Symbol: ADGRB1;
  Gene Name: adhesion G prt-coupled receptor B1;
  ENSP ID: ENSP00000427783
MRGQAAAPGPVWILAPLLLLLLLLGRRARAAAGADAGPGPEPCATLVQGKFFGYFSAAAVFPANASRCSWTLRNPDPRRYTLYMKVAKAPVPCSGPGRVRTYQFDSFLESTRTYLGVESFDEVLRLCDPSAPLAFLQASKQFLQMRRQQPPQHDGLRPRAGPPGPTDDFSVEYLVVGNRNPSRAACQMLCRWLDACLAGSRSSHPCGIMQTPCACLGGEAGGPAAGPLAPRGDVCLRDAVAGGPENCLTSLTQDRGGHGATGGWKLWSLWGECTRDCGGGLQTRTRTCLPAPGVEGGGCEGVLEEGRQCNREACGPAGRTSSRSQSLRSTDARRREELGDELQQFGFPAPQTGDPAAEEWSPWSVCSSTCGEGWQTRTRFCVSSSYSTQCSGPLREQRLCNNSAVCPVHGAWDEWSPWSLCSSTCGRGFRDRTRTCRPPQFGGNPCEGPEKQTKFCNIALCPGRAVDGNWNEWSSWSACSASCSQGRQQRTRECNGPSYGGAECQGHWVETRDCFLQQCPVDGKWQAWASWGSCSVTCGAGSQRRERVCSGPFFGGAACQGPQDEYRQCGTQRCPEPHEICDEDNFGAVIWKETPAGEVAAVRCPRNATGLILRRCELDEEGIAYWEPPTYIRCVSIDYRNIQMMTREHLAKAQRGLPGEGVSEVIQTLVEISQDGTSYSGDLLSTIDVLRNMTEIFRRAYYSPTPGDVQNFVQILSNLLAEENRDKWEEAQLAGPNAKELFRLVEDFVDVIGFRMKDLRDAYQVTDNLVLSIHKLPASGATDISFPMKGWRATGDWAKVPEDRVTVSKSVFSTGLTEADEASVFVVGTVLYRNLGSFLALQRNTTVLNSKVISVTVKPPPRSLRTPLEIEFAHMYNGTTNQTCILWDETDVPSSSAPPQLGPWSWRGCRTVPLDALRTRCLCDRLSTFAILAQLSADANMEKATLPSVTLIVGCGVSSLTLLMLVIIYVSVWRYIRSERSVILINFCLSIISSNALILIGQTQTRNKVVCTLVAAFLHFFFLSSFCWVLTEAWQSYMAVTGHLRNRLIRKRFLCLGWGLPALVVAISVGFTKAKGYSTMNYCWLSLEGGLLYAFVGPAAAVVLGLPVELLRGAAAAGADLDVGCARRHRPPLRPLPDPLRCLRLAGGLRHRHGALYPP

SEQ ID NO: 2935 - protein, 1584 aa, Homo sapiens; identical to SEQ ID NO: 2933
  Payload ID: 674;
  Gene Symbol: ADGRB1;
  Gene Name: adhesion G prt-coupled receptor B1;
  Uniprot ID:  O14514;
  ENSP ID: ENSP00000430945

SEQ ID NO: 2936 - protein, 1584 aa, Homo sapiens
  Payload ID: 675;
  Gene Symbol: ADGRB2;
  Gene Name: adhesion G prt-coupled receptor B2;
  Uniprot ID:  O60241;
  ENSP ID: ENSP00000362759
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 2937 - protein, 1585 aa, Homo sapiens
  Payload ID: 675;
  Gene Symbol: ADGRB2;
  Gene Name: adhesion G prt-coupled receptor B2;
  Uniprot ID:  O60241;
  ENSP ID: ENSP00000362762
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 2938 - protein, 1554 aa, Homo sapiens
  Payload ID: 675;
  Gene Symbol: ADGRB2;
  Gene Name: adhesion G prt-coupled receptor B2;
  ENSP ID: ENSP00000381548
MTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKDKPSPGERPSLSQHRRHQSWSTFKSMTLGSLPPKPRERLTLHRAAAWEPTEPPDGDFQTEV

SEQ ID NO: 2939 - protein, 1466 aa, Homo sapiens
  Payload ID: 675;
  Gene Symbol: ADGRB2;
  Gene Name: adhesion G prt-coupled receptor B2;
  ENSP ID: ENSP00000381550
MTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKDKPSPGERPSLSQHRRHQSWSTFKSMTLGSLPPKPRERLTLHRAAAWEPTEPPDGDFQTEV

SEQ ID NO: 2940 - protein, 1499 aa, Homo sapiens
  Payload ID: 675;
  Gene Symbol: ADGRB2;
  Gene Name: adhesion G prt-coupled receptor B2;
  ENSP ID: ENSP00000381555
MTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKDKPSPGERPSLSQHRRHQSWSTFKSMTLGSLPPKPRERLTLHRAAAWEPTEPPDGDFQTEV

SEQ ID NO: 2941 - protein, 1500 aa, Homo sapiens
  Payload ID: 675;
  Gene Symbol: ADGRB2;
  Gene Name: adhesion G prt-coupled receptor B2;
  ENSP ID: ENSP00000381564
MLSLRGPDTHGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 2942 - protein, 847 aa, Homo sapiens
  Payload ID: 675;
  Gene Symbol: ADGRB2;
  Gene Name: adhesion G prt-coupled receptor B2;
  ENSP ID: ENSP00000410921
GKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQ

SEQ ID NO: 2943 - protein, 1 aa, Homo sapiens
  Payload ID: 675;
  Gene Symbol: ADGRB2;
  Gene Name: adhesion G prt-coupled receptor B2;
  ENSP ID: ENSP00000414758
M

SEQ ID NO: 2944 - protein, 1551 aa, Homo sapiens
  Payload ID: 675;
  Gene Symbol: ADGRB2;
  Gene Name: adhesion G prt-coupled receptor B2;
  Uniprot ID:  O60241;
  ENSP ID: ENSP00000435397
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 2945 - protein, 507 aa, Homo sapiens
  Payload ID: 675;
  Gene Symbol: ADGRB2;
  Gene Name: adhesion G prt-coupled receptor B2;
  ENSP ID: ENSP00000437219
MHLPRQHGSAHLGHLYAYAKFSAHDWHLHAQGHAICNAHGKGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCP

SEQ ID NO: 2946 - protein, 728 aa, Homo sapiens
  Payload ID: 676;
  Gene Symbol: ADGRB3;
  Gene Name: adhesion G prt-coupled receptor B3;
  ENSP ID: ENSP00000238918
MLLPQGKEAVEGKKCQGRQRRAGLSEVWSRKLRNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGLPALVVATSVGFTRTKGYGTDHYCWLSLEGGLLYAFVGPAAAVVLVNMVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVQDAFRCRLRNCQDPINADSSSSFPNGHAQIMTDFEKDVDIACRSVLHKDIGPCRAATITGTLSRISLNDDEEEKGTNPEGLSYSTLPGNVISKVIIQQPTGLHMPMSMNELSNPCLKKENSELRRTVYLCTDDNLRGADMDIVHPQERMMESDYIVMPRSSVNNQPSMKEESKMNIGMETLPHERLLHYKVNPEFNMNPPVMDQFNMNLEQHLAPQEHMQNLPFEPRTAVKNFMASELDDNAGLSRSETGSTISMSSLERRKSRYSDLDFEKVMHTRKRHMELFQELNQKFQTLDRFRDIPNTSSMENPAPNKNPWDTFKNPSEYPHYTTINVLDTEAKDALELRPAEWEKCLNLPLDVQEGDFQTEV

SEQ ID NO: 2947 - protein, 1522 aa, Homo sapiens
  Payload ID: 676;
  Gene Symbol: ADGRB3;
  Gene Name: adhesion G prt-coupled receptor B3;
  Uniprot ID:  O60242;
  ENSP ID: ENSP00000359630
MKAVRNLLIYIFSTYLLVMFGFNAAQDFWCSTLVKGVIYGSYSVSEMFPKNFTNCTWTLENPDPTKYSIYLKFSKKDLSCSNFSLLAYQFDHFSHEKIKDLLRKNHSIMQLCNSKNAFVFLQYDKNFIQIRRVFPTNFPGLQKKGEEDQKSFFEFLVLNKVSPSQFGCHVLCTWLESCLKSENGRTESCGIMYTKCTCPQHLGEWGIDDQSLILLNNVVLPLNEQTEGCLTQELQTTQVCNLTREAKRPPKEEFGMMGDHTIKSQRPRSVHEKRVPQEQADAAKFMAQTGESGVEEWSQWSTCSVTCGQGSQVRTRTCVSPYGTHCSGPLRESRVCNNTALCPVHGVWEEWSPWSLCSFTCGRGQRTRTRSCTPPQYGGRPCEGPETHHKPCNIALCPVDGQWQEWSSWSQCSVTCSNGTQQRSRQCTAAAHGGSECRGPWAESRECYNPECTANGQWNQWGHWSGCSKSCDGGWERRIRTCQGAVITGQQCEGTGEEVRRCNEQRCPAPYEICPEDYLMSMVWKRTPAGDLAFNQCPLNATGTTSRRCSLSLHGVAFWEQPSFARCISNEYRHLQHSIKEHLAKGQRMLAGDGMSQVTKTLLDLTQRKNFYAGDLLMSVEILRNVTDTFKRASYIPASDGVQNFFQIVSNLLDEENKEKWEDAQQIYPGSIELMQVIEDFIHIVGMGMMDFQNSYLMTGNVVASIQKLPAASVLTDINFPMKGRKGMVDWARNSEDRVVIPKSIFTPVSSKELDESSVFVLGAVLYKNLDLILPTLRNYTVINSKIIVVTIRPEPKTTDSFLEIELAHLANGTLNPYCVLWDDSKTNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGLPALVVATSVGFTRTKGYGTDHYCWLSLEGGLLYAFVGPAAAVVLVNMVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVQDAFRCRLRNCQDPINADSSSSFPNGHAQIMTDFEKDVDIACRSVLHKDIGPCRAATITGTLSRISLNDDEEEKGTNPEGLSYSTLPGNVISKVIIQQPTGLHMPMSMNELSNPCLKKENSELRRTVYLCTDDNLRGADMDIVHPQERMMESDYIVMPRSSVNNQPSMKEESKMNIGMETLPHERLLHYKVNPEFNMNPPVMDQFNMNLEQHLAPQEHMQNLPFEPRTAVKNFMASELDDNAGLSRSETGSTISMSSLERRKSRYSDLDFEKVMHTRKRHMELFQELNQKFQTLDRFRDIPNTSSMENPAPNKNPWDTFKNPSEYPHYTTINVLDTEAKDALELRPAEWEKCLNLPLDVQEGDFQTEV

SEQ ID NO: 2948 - protein, 1522 aa, Homo sapiens; identical to SEQ ID NO: 2947
  Payload ID: 676;
  Gene Symbol: ADGRB3;
  Gene Name: adhesion G prt-coupled receptor B3;
  Uniprot ID:  O60242;
  ENSP ID: ENSP00000441821

SEQ ID NO: 2949 - protein, 145 aa, Homo sapiens
  Payload ID: 676;
  Gene Symbol: ADGRB3;
  Gene Name: adhesion G prt-coupled receptor B3;
  ENSP ID: ENSP00000473827
MHLNYILFNNKNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLT

SEQ ID NO: 2950 - protein, 68 aa, Homo sapiens
  Payload ID: 676;
  Gene Symbol: ADGRB3;
  Gene Name: adhesion G prt-coupled receptor B3;
  ENSP ID: ENSP00000474165
MESSGTPSVTLIVGSGLSCLALITLAVVYAALWRYIRSERSIILINFCLSIISSNILILVGQTQTHNK

SEQ ID NO: 2951 - protein, 874 aa, Homo sapiens
  Payload ID: 677;
  Gene Symbol: ADGRD1;
  Gene Name: adhesion G prt-coupled receptor D1;
  Uniprot ID:  Q6QNK2;
  ENSP ID: ENSP00000261654
MEKLLRLCCWYSWLLLFYYNFQVRGVYSRSQDHPGFQVLASASHYWPLENVDGIHELQDTTGDIVEGKVNKGIYLKEEKGVTLLYYGRYNSSCISKPEQCGPEGVTFSFFWKTQGEQSRPIPSAYGGQVISNGFKVCSSGGRGSVELYTRDNSMTWEASFSPPGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKTFLKAVGEILLLPGWIALSEDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 2952 - protein, 156 aa, Homo sapiens
  Payload ID: 677;
  Gene Symbol: ADGRD1;
  Gene Name: adhesion G prt-coupled receptor D1;
  ENSP ID: ENSP00000334127
MQVVPLEVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 2953 - protein, 393 aa, Homo sapiens
  Payload ID: 677;
  Gene Symbol: ADGRD1;
  Gene Name: adhesion G prt-coupled receptor D1;
  Uniprot ID:  Q6QNK2;
  ENSP ID: ENSP00000438021
MHRVCFLSFQTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 2954 - protein, 220 aa, Homo sapiens
  Payload ID: 677;
  Gene Symbol: ADGRD1;
  Gene Name: adhesion G prt-coupled receptor D1;
  ENSP ID: ENSP00000442501
MEKLLRLCCWYSWLLLFYYNFQVRGVYSRSQDHPGFQVLASASHYWPLENVDGIHELQDTTGDIVEGKVNKGIYLKEEKGVTLLYYGRYNSSCISKPEQCGPEGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPII

SEQ ID NO: 2955 - protein, 906 aa, Homo sapiens
  Payload ID: 677;
  Gene Symbol: ADGRD1;
  Gene Name: adhesion G prt-coupled receptor D1;
  Uniprot ID:  Q6QNK2;
  ENSP ID: ENSP00000444425
MEKLLRLCCWYSWLLLFYYNFQVRGVYSRSQDHPGFQVLASASHYWPLENVDGIHELQDTTGASRTHKLTVLPSRNATFVYSNDSAYSNLSATVDIVEGKVNKGIYLKEEKGVTLLYYGRYNSSCISKPEQCGPEGVTFSFFWKTQGEQSRPIPSAYGGQVISNGFKVCSSGGRGSVELYTRDNSMTWEASFSPPGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKTFLKAVGEILLLPGWIALSEDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 2956 - protein, 345 aa, Homo sapiens
  Payload ID: 677;
  Gene Symbol: ADGRD1;
  Gene Name: adhesion G prt-coupled receptor D1;
  ENSP ID: ENSP00000482235
MQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEARWAKEGRAESLSRMVAGQKGCMITKPSDPLIATPSDPLQGLRWIPVAGRQCSHGSPPAHPPACPPRICLFASLSHSPRDIHC

SEQ ID NO: 2957 - protein, 972 aa, Homo sapiens
  Payload ID: 678;
  Gene Symbol: ADGRD2;
  Gene Name: adhesion G prt-coupled receptor D2;
  Uniprot ID:  Q7Z7M1;
  ENSP ID: ENSP00000335156
  MOD_RES (1)..(1): Any amino acid
XSGVSLGPPPTPQVNQGTLGPQVAPVAAGEVVKTAGGVCKFSGQRLSWWQAQESCEQQFGHLALQPPDGVLASRLRDPVWVGQREAPLRRPPQRRARTTAVLVFDERTADRAARLRSPLPELAALTACTHVQWDCASPDPAALFSVAAPALPNALQLRAFAEPGGVVRAALVVRGQHAPFLAAFRADGRWHHVCATWEQRGGRWALFSDGRRRAGARGLGAGHPVPSGGILVLGQDQDSLGGGFSVRHALSGNLTDFHLWARALSPAQLHRARACAPPSEGLLFRWDPGALDVTPSLLPTVWVRLLCPVPSEECPTWNPGPRSEGSELCLEPQPFLCCYRTEPYRRLQDAQSWPGQDVISRVNALANDIVLLPDPLSEVHGALSPAEASSFLGLLEHVLAMEMAPLGPAALLAVVRFLKRVVALGAGDPELLLTGPWEQLSQGVVSVASLVLEEQVADTWLSLREVIGGPMALVASVQRLAPLLSTSMTSERPRMRIQHRHAGLEVRSLRLREASTRGCLFTMPGGRPEGPGHIHIPASEVRRLLRKGLSGVTVIHSWFTSRVFQHTLEGPDLEPQAPASSEEANRVQRFLSTQVGSAIISSEVWDVTGEVNVAMTFHLQHRAQSPLFPPHPPSPYTGGAWATTGCSVAALYLDSTACFCNHSTSFAILLQIYEVQRGPEEESLLRTLSFVGCGVSFCALTTTFLLFLVAGVPKSERTTVHKNLTFSLASAEGFLMTSEWAKANEVACVAVTVAMHFLFLVAFSWMLVEGLLLWRKVVAVSMHPGPGMRLYHATGWGVPVGIVAVTLAMLPHDYVAPGHCWLNVHTNAIWAFVGPVLFVLTANTCILARVVMITVSSARRRARMLSPQPCLQQQIWTQIWATVKPVLVLLPVLGLTWLAGILVHLSPAWAYAAVGLNSIQGLYIFLVYAACNEEVRSALQRMAEKKVAEGPMALELPQHSPPLQTRRDRLWN

SEQ ID NO: 2958 - protein, 41 aa, Homo sapiens
  Payload ID: 678;
  Gene Symbol: ADGRD2;
  Gene Name: adhesion G prt-coupled receptor D2;
  ENSP ID: ENSP00000480501
FLVAFSWMLVEGLLLWRKVVAVSMHPGPGMRLYHATGWGPR

SEQ ID NO: 2959 - protein, 821 aa, Homo sapiens
  Payload ID: 679;
  Gene Symbol: ADGRE1;
  Gene Name: adhesion G prt-coupled receptor E1;
  Uniprot ID:  Q14246;
  ENSP ID: ENSP00000250572
MRGFNLLLFWGCCVMHSWEGHIRPTRKPNTKGNNCRDSTLCPAYATCTNTVDSYYCACKQGFLSSNGQNHFKDPGVRCKDIDECSQSPQPCGPNSSCKNLSGRYKCSCLDGFSSPTGNDWVPGKPGNFSCTDINECLTSSVCPEHSDCVNSMGSYSCSCQVGFISRNSTCEDVDECADPRACPEHATCNNTVGNYSCFCNPGFESSSGHLSFQGLKASCEDIDECTEMCPINSTCTNTPGSYFCTCHPGFAPSNGQLNFTDQGVECRDIDECRQDPSTCGPNSICTNALGSYSCGCIAGFHPNPEGSQKDGNFSCQRVLFKCKEDVIPDNKQIQQCQEGTAVKPAYVSFCAQINNIFSVLDKVCENKTTVVSLKNTTESFVPVLKQISTWTKFTKEETSSLATVFLESVESMTLASFWKPSANITPAVRTEYLDIESKVINKECSEENVTLDLVAKGDKMKIGCSTIEESESTETTGVAFVSFVGMESVLNERFFKDHQAPLTTSEIKLKMNSRVVGGIMTGEKKDGFSDPIIYTLENIQPKQKFERPICVSWSTDVKGGRWTSFGCVILEASETYTICSCNQMANLAVIMASGELTMGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 2960 - protein, 886 aa, Homo sapiens
  Payload ID: 679;
  Gene Symbol: ADGRE1;
  Gene Name: adhesion G prt-coupled receptor E1;
  Uniprot ID:  Q14246;
  ENSP ID: ENSP00000311545
MRGFNLLLFWGCCVMHSWEGHIRPTRKPNTKGNNCRDSTLCPAYATCTNTVDSYYCACKQGFLSSNGQNHFKDPGVRCKDIDECSQSPQPCGPNSSCKNLSGRYKCSCLDGFSSPTGNDWVPGKPGNFSCTDINECLTSSVCPEHSDCVNSMGSYSCSCQVGFISRNSTCEDVDECADPRACPEHATCNNTVGNYSCFCNPGFESSSGHLSFQGLKASCEDIDECTEMCPINSTCTNTPGSYFCTCHPGFAPSNGQLNFTDQGVECRDIDECRQDPSTCGPNSICTNALGSYSCGCIAGFHPNPEGSQKDGNFSCQRVLFKCKEDVIPDNKQIQQCQEGTAVKPAYVSFCAQINNIFSVLDKVCENKTTVVSLKNTTESFVPVLKQISTWTKFTKEETSSLATVFLESVESMTLASFWKPSANITPAVRTEYLDIESKVINKECSEENVTLDLVAKGDKMKIGCSTIEESESTETTGVAFVSFVGMESVLNERFFKDHQAPLTTSEIKLKMNSRVVGGIMTGEKKDGFSDPIIYTLENIQPKQKFERPICVSWSTDVKGGRWTSFGCVILEASETYTICSCNQMANLAVIMASGELTMDFSLYIISHVGIIISLVCLVLAIATFLLCRSIRNHNTYLHLHLCVCLLLAKTLFLAGIHKTDNKMGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 2961 - protein, 867 aa, Homo sapiens
  Payload ID: 679;
  Gene Symbol: ADGRE1;
  Gene Name: adhesion G prt-coupled receptor E1;
  Uniprot ID:  Q14246;
  ENSP ID: ENSP00000370811
MRGFNLLLFWGCCVMHSWEGHIRPTRKPNTKGNNCRDSTLCPAYATCTNTVDSYYCACKQGFLSSNGQNHFKDPGVRCKDINECLTSSVCPEHSDCVNSMGSYSCSCQVGFISRNSTCEDVDECADPRACPEHATCNNTVGNYSCFCNPGFESSSGHLSFQGLKASCEDIDECTEMCPINSTCTNTPGSYFCTCHPGFAPSNGQLNFTDQGVECRDIDECRQDPSTCGPNSICTNALGSYSCGCIAGFHPNPEGSQKDGNFSCQRVLFKCKEDVIPDNKQIQQCQEGTAVKPAYVSFCAQINNIFSVLDKVCENKTTVVSLKNTTESFVPVLKQISTWTKFTKEETSSLATVFLESVESMTLASFWKPSANITPAVRTEYLDIESKVINKECSEENVTLDLVAKGDKMKIGCSTIEESESTETTGVAFVSFVGMESVLNERFFKDHQAPLTTSEIKLKMNSRVVGGIMTGEKKDGFSDPIIYTLENIQPKQKFERPICVSWSTDVKGGRWTSFGCVILEASETYTICSCNQMANLAVIMASGELTMDFSLYIISHVGIIISLVCLVLAIATFLLCRSIRNHNTYLHLHLCVCLLLAKTLFLAGIHKTDNKMGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVVSKYYNSLAKCVLKEEQGDLRDLEFPGTCAAERINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 2962 - protein, 745 aa, Homo sapiens
  Payload ID: 679;
  Gene Symbol: ADGRE1;
  Gene Name: adhesion G prt-coupled receptor E1;
  Uniprot ID:  Q14246;
  ENSP ID: ENSP00000370814
MRGFNLLLFWGCCVMHSWEGHIRPTRKPNTKGNNCRDSTLCPAYATCTNTVDSYYCACKQGFLSSNGQNHFKDPGVRCKDIDECTEMCPINSTCTNTPGSYFCTCHPGFAPSNGQLNFTDQGVECRDIDECRQDPSTCGPNSICTNALGSYSCGCIAGFHPNPEGSQKDGNFSCQRVLFKCKEDVIPDNKQIQQCQEGTAVKPAYVSFCAQINNIFSVLDKVCENKTTVVSLKNTTESFVPVLKQISTWTKFTKEETSSLATVFLESVESMTLASFWKPSANITPAVRTEYLDIESKVINKECSEENVTLDLVAKGDKMKIGCSTIEESESTETTGVAFVSFVGMESVLNERFFKDHQAPLTTSEIKLKMNSRVVGGIMTGEKKDGFSDPIIYTLENIQPKQKFERPICVSWSTDVKGGRWTSFGCVILEASETYTICSCNQMANLAVIMASGELTMDFSLYIISHVGIIISLVCLVLAIATFLLCRSIRNHNTYLHLHLCVCLLLAKTLFLAGIHKTDNKMGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 2963 - protein, 709 aa, Homo sapiens
  Payload ID: 679;
  Gene Symbol: ADGRE1;
  Gene Name: adhesion G prt-coupled receptor E1;
  Uniprot ID:  Q14246;
  ENSP ID: ENSP00000405974
MRGFNLLLFWGCCVMHSWEGHIRPTRKPNTKGNNCRDSTLCPAYATCTNTVDSYYCACKQGFLSSNGQNHFKDPGVRCKDIDECSQSPQPCGPNSSCKNLSGRYKCSCLDGFSSPTGNDWVPGKPGNFSCTDINECLTSRVLFKCKEDVIPDNKQIQQCQEGTAVKPAYVSFCAQINNIFSVLDKVCENKTTVVSLKNTTESFVPVLKQISTWTKFTKEETSSLATVFLESVESMTLASFWKPSANITPAVRTEYLDIESKVINKECSEENVTLDLVAKGDKMKIGCSTIEESESTETTGVAFVSFVGMESVLNERFFKDHQAPLTTSEIKLKMNSRVVGGIMTGEKKDGFSDPIIYTLENIQPKQKFERPICVSWSTDVKGGRWTSFGCVILEASETYTICSCNQMANLAVIMASGELTMDFSLYIISHVGIIISLVCLVLAIATFLLCRSIRNHNTYLHLHLCVCLLLAKTLFLAGIHKTDNKMGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 2964 - protein, 318 aa, Homo sapiens
  Payload ID: 679;
  Gene Symbol: ADGRE1;
  Gene Name: adhesion G prt-coupled receptor E1;
  ENSP ID: ENSP00000472553
CRDSTLCPAYATCTNTVDSYYCACKQGFLSSNGQNHFKDPGVRCKDIDECSQSPQPCGPNSSCKNLSGRYKCSCLDGFSSPTGNDWVPGKPGNFSCTDINECLTSSVCPEHSDCVNSMGSYSCSCQVGFISRNSTCEDVDECADPRACPEHATCNNTVGNYSCFCNPGFESSSGHLSFQGLKASCEDIDECTEMCPINSTCTNTPGSYFCTCHPGFAPSNGQLNFTDQGVECRGVLFKCKEDVIPDNKQIQQCQEGTAVKPAYVSFCAQINNIFSVLDKVCENKTTVVSLKNTTESFVPVLKQISTWTKFTKEETSSL

SEQ ID NO: 2965 - protein, 823 aa, Homo sapiens
  Payload ID: 680;
  Gene Symbol: ADGRE2;
  Gene Name: adhesion G prt-coupled receptor E2;
  Uniprot ID:  Q9UHX3;
  ENSP ID: ENSP00000319883
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 2966 - protein, 379 aa, Homo sapiens
  Payload ID: 680;
  Gene Symbol: ADGRE2;
  Gene Name: adhesion G prt-coupled receptor E2;
  ENSP ID: ENSP00000376689
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGGGSRADCHHLHGAERLSAVPPPGGPHFSPV

SEQ ID NO: 2967 - protein, 765 aa, Homo sapiens
  Payload ID: 680;
  Gene Symbol: ADGRE2;
  Gene Name: adhesion G prt-coupled receptor E2;
  Uniprot ID:  Q9UHX3;
  ENSP ID: ENSP00000376692
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHREEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 2968 - protein, 681 aa, Homo sapiens
  Payload ID: 680;
  Gene Symbol: ADGRE2;
  Gene Name: adhesion G prt-coupled receptor E2;
  Uniprot ID:  Q9UHX3;
  ENSP ID: ENSP00000469277
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 2969 - protein, 330 aa, Homo sapiens
  Payload ID: 680;
  Gene Symbol: ADGRE2;
  Gene Name: adhesion G prt-coupled receptor E2;
  ENSP ID: ENSP00000469605
  MOD_RES (1)..(1): Any amino acid
XFKNESENTCQDVDECQQNPRLCKSYGTCVNTLGSYTCQCLPGFKLKPEDPKLCTDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPVSDPETEGALCLLGAWPEWMWSLGHHRLQHNRHQRHQHHLPLHPPEQLCRPHGPLRCAGGGSRADCHHLHGAERLSAVPPPGGPHFSPV

SEQ ID NO: 2970 - protein, 774 aa, Homo sapiens
  Payload ID: 680;
  Gene Symbol: ADGRE2;
  Gene Name: adhesion G prt-coupled receptor E2;
  Uniprot ID:  Q9UHX3;
  ENSP ID: ENSP00000470725
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 2971 - protein, 831 aa, Homo sapiens
  Payload ID: 680;
  Gene Symbol: ADGRE2;
  Gene Name: adhesion G prt-coupled receptor E2;
  ENSP ID: ENSP00000471297
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTPGTVVQACNASTLGGQSRKIT

SEQ ID NO: 2972 - protein, 812 aa, Homo sapiens
  Payload ID: 680;
  Gene Symbol: ADGRE2;
  Gene Name: adhesion G prt-coupled receptor E2;
  Uniprot ID:  Q9UHX3;
  ENSP ID: ENSP00000472280
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 2973 - protein, 730 aa, Homo sapiens
  Payload ID: 680;
  Gene Symbol: ADGRE2;
  Gene Name: adhesion G prt-coupled receptor E2;
  Uniprot ID:  Q9UHX3;
  ENSP ID: ENSP00000472735
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 2974 - protein, 652 aa, Homo sapiens
  Payload ID: 681;
  Gene Symbol: ADGRE3;
  Gene Name: adhesion G prt-coupled receptor E3;
  Uniprot ID:  Q9BY15;
  ENSP ID: ENSP00000253673
MQGPLLLPGLCFLLSLFGAVTQKTKTSCAKCPPNASCVNNTHCTCNHGYTSGSGQKLFTFPLETCNDINECTPPYSVYCGFNAVCYNVEGSFYCQCVPGYRLHSGNEQFSNSNENTCQDTTSSKTTEGRKELQKIVDKFESLLTNQTLWRTEGRQEISSTATTILRDVESKVLETALKDPEQKVLKIQNDSVAIETQAITDNCSEERKTFNLNVQMNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIRNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 2975 - protein, 600 aa, Homo sapiens
  Payload ID: 681;
  Gene Symbol: ADGRE3;
  Gene Name: adhesion G prt-coupled receptor E3;
  Uniprot ID:  Q9BY15;
  ENSP ID: ENSP00000340758
MQGPLLLPGLCFLLSLFGAVTQKTKTSCAKCPPNASCVNNTHCTCNHGYTSGSGQKLFTFPLETCNDTTSSKTTEGRKELQKIVDKFESLLTNQTLWRTEGRQEISSTATTILRDVESKVLETALKDPEQKVLKIQNDSVAIETQAITDNCSEERKTFNLNVQMNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIRNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 2976 - protein, 526 aa, Homo sapiens
  Payload ID: 681;
  Gene Symbol: ADGRE3;
  Gene Name: adhesion G prt-coupled receptor E3;
  ENSP ID: ENSP00000396208
MQGPLLLPGLCFLLSLFGAVTQKTKTSCAKCPPNASCVNNTHCTCNHGYTSGSGQKLFTFPLETCNAIETQAITDNCSEERKTFNLNVQMNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIRNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 2977 - protein, 57 aa, Homo sapiens
  Payload ID: 681;
  Gene Symbol: ADGRE3;
  Gene Name: adhesion G prt-coupled receptor E3;
  ENSP ID: ENSP00000469965
MQGPLLLPGLCFLLSLFGAVTQKTKSECSEPEQRTCGPRAGPGATHGLQWAGEKCLF

SEQ ID NO: 2978 - protein, 437 aa, Homo sapiens
  Payload ID: 681;
  Gene Symbol: ADGRE3;
  Gene Name: adhesion G prt-coupled receptor E3;
  ENSP ID: ENSP00000471853
MNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIRNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 2979 - protein, 835 aa, Homo sapiens
  Payload ID: 682;
  Gene Symbol: ADGRE5;
  Gene Name: adhesion G prt-coupled receptor E5;
  Uniprot ID:  P48960;
  ENSP ID: ENSP00000242786
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 2980 - protein, 786 aa, Homo sapiens
  Payload ID: 682;
  Gene Symbol: ADGRE5;
  Gene Name: adhesion G prt-coupled receptor E5;
  Uniprot ID:  P48960;
  ENSP ID: ENSP00000349918
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 2981 - protein, 742 aa, Homo sapiens
  Payload ID: 682;
  Gene Symbol: ADGRE5;
  Gene Name: adhesion G prt-coupled receptor E5;
  Uniprot ID:  P48960;
  ENSP ID: ENSP00000351413
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 2982 - protein, 154 aa, Homo sapiens
  Payload ID: 682;
  Gene Symbol: ADGRE5;
  Gene Name: adhesion G prt-coupled receptor E5;
  ENSP ID: ENSP00000465800
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQGKNHPTSSDFPSMRFGVTRAILAASREQGLGCRVSAWRL

SEQ ID NO: 2983 - protein, 156 aa, Homo sapiens
  Payload ID: 682;
  Gene Symbol: ADGRE5;
  Gene Name: adhesion G prt-coupled receptor E5;
  ENSP ID: ENSP00000467351
MGGRVFLGCARWCPQNSSCVNATACRCNPGFSSFSEIITTPTETCDDINECATPSKVSCGKFSDCWNTEGSYDCVCSPGYEPVSGAKTFKNESENTCQDVDECSSGQHQCDSSTVCFNTVGSYSCRCRPGWKPRHGIPNNQKDTVCEDMTFSTWTP

SEQ ID NO: 2984 - protein, 164 aa, Homo sapiens
  Payload ID: 682;
  Gene Symbol: ADGRE5;
  Gene Name: adhesion G prt-coupled receptor E5;
  ENSP ID: ENSP00000467478
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVNECTSGQNPCHSSTHCLNNVGSYQCRCRPGWQPIPGSPNGPNNTVCE

SEQ ID NO: 2985 - protein, 713 aa, Homo sapiens
  Payload ID: 683;
  Gene Symbol: ADGRF1;
  Gene Name: adhesion G prt-coupled receptor F1;
  ENSP ID: ENSP00000283297
MDISIQRNGSIVAGYEVVGSSSASELLSAIEHVAEKAKTALHKLFPLEDGSFRVFGKAQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVITIAVTQPSNTYKRKDVCWLNWSNGSKPLLAFVVPALAIVAVNFVVVLLVLTKLWRPTVGERLSRDDKATIIRVGKSLLILTPLLGLTWGFGIGTIVDSQNLAWHVIFALLNAFQGFFILCFGILLDSKLRQLLFNKLSALSSWKQTEKQNSSDLSAKPKFSKPFNPLQNKGHYAFSHTGDSSDNIMLTQFVSNE

SEQ ID NO: 2986 - protein, 218 aa, Homo sapiens
  Payload ID: 683;
  Gene Symbol: ADGRF1;
  Gene Name: adhesion G prt-coupled receptor F1;
  Uniprot ID:  Q5T601;
  ENSP ID: ENSP00000360289
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRMSLLSPKLECNGTI

SEQ ID NO: 2987 - protein, 910 aa, Homo sapiens
  Payload ID: 683;
  Gene Symbol: ADGRF1;
  Gene Name: adhesion G prt-coupled receptor F1;
  Uniprot ID:  Q5T601;
  ENSP ID: ENSP00000360299
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRNGSIVAGYEVVGSSSASELLSAIEHVAEKAKTALHKLFPLEDGSFRVFGKAQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVITIAVTQPSNTYKRKDVCWLNWSNGSKPLLAFVVPALAIVAVNFVVVLLVLTKLWRPTVGERLSRDDKATIIRVGKSLLILTPLLGLTWGFGIGTIVDSQNLAWHVIFALLNAFQGFFILCFGILLDSKLRQLLFNKLSALSSWKQTEKQNSSDLSAKPKFSKPFNPLQNKGHYAFSHTGDSSDNIMLTQFVSNE

SEQ ID NO: 2988 - protein, 160 aa, Homo sapiens
  Payload ID: 683;
  Gene Symbol: ADGRF1;
  Gene Name: adhesion G prt-coupled receptor F1;
  ENSP ID: ENSP00000417732
EYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRPV

SEQ ID NO: 2989 - protein, 137 aa, Homo sapiens
  Payload ID: 683;
  Gene Symbol: ADGRF1;
  Gene Name: adhesion G prt-coupled receptor F1;
  ENSP ID: ENSP00000419109
  MOD_RES (1)..(1): Any amino acid
XWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRTVIHLWNLV

SEQ ID NO: 2990 - protein, 708 aa, Homo sapiens
  Payload ID: 684;
  Gene Symbol: ADGRF2;
  Gene Name: adhesion G prt-coupled receptor F2;
  Uniprot ID:  Q8IZF7;
  ENSP ID: ENSP00000296862
MGLTAYGNRRVQPGELPFGANLTLIHTRAQPVICSKLLLTKRVSPISFFLSKFQNSWGEDGWVQLDQLPSPNAVSSDQVHCSAGCTHRKCGWAASKSKEKVPARPHGVCDGVCTDYSQCTQPCPPDTQGNMGFSCRQKTWHKITDTCQTLNALNIFEEDSRLVQPFEDNIKISVYTGKSETITDMLLQKCPTDLSCVIRNIQQSPWIPGNIAVIVQLLHNISTAIWTGVDEAKMQSYSTIANHILNSKSISNWTFIPDRNSSYILLHSVNSFARRLFIDKHPVDISDVFIHTMGTTISGDNIGKNFTFSMRINDTSNEVTGRVLISRDELRKVPSPSQVISIAFPTIGAILEASLLENVTVNGLVLSAILPKELKRISLIFEKISKSEERRTQCVGWHSVENRWDQQACKMIQENSQQAVCKCRPSKLFTSFSILMSPHILESLILTYITYVGLGISICSLILCLSIEVLVWSQVTKTEITYLRHVCIVNIAATLLMADVWFIVASFLSGPITHHKGCVAATFFVHFFYLSVFFWMLAKALLILYGIMIVFHTLPKSVLVASLFSVGYGCPLAIAAITVAATEPGKGYLRPEICWLNWDMTKALLAFVIPALAIVVVNLITVTLVIVKTQRAAIGNSMFQEVRAIVRISKNIAILTPLLGLTWGFGVATVIDDRSLAFHIIFSLLNAFQVSPDASDQVQSERIHEDVL

SEQ ID NO: 2991 - protein, 642 aa, Homo sapiens
  Payload ID: 684;
  Gene Symbol: ADGRF2;
  Gene Name: adhesion G prt-coupled receptor F2;
  Uniprot ID:  Q8IZF7;
  ENSP ID: ENSP00000381727
MTHILLLYYLVFLLPTESCRTLYQAASKSKEKVPARPHGVCDGVCTDYSQCTQPCPPDTQGNMGFSCRQKTWHKITDTCQTLNALNIFEEDSRLVQPFEDNIKISVYTGKSETITDMLLQKCPTDLSCVIRNIQQSPWIPGNIAVIVQLLHNISTAIWTGVDEAKMQSYSTIANHILNSKSISNWTFIPDRNSSYILLHSVNSFARRLFIDKHPVDISDVFIHTMGTTISGDNIGKNFTFSMRINDTSNEVTGRVLISRDELRKVPSPSQVISIAFPTIGAILEASLLENVTVNGLVLSAILPKELKRISLIFEKISKSEERRTQCVGWHSVENRWDQQACKMIQENSQQAVCKCRPSKLFTSFSILMSPHILESLILTYITYVGLGISICSLILCLSIEVLVWSQVTKTEITYLRHVCIVNIAATLLMADVWFIVASFLSGPITHHKGCVAATFFVHFFYLSVFFWMLAKALLILYGIMIVFHTLPKSVLVASLFSVGYGCPLAIAAITVAATEPGKGYLRPEICWLNWDMTKALLAFVIPALAIVVVNLITVTLVIVKTQRAAIGNSMFQEVRAIVRISKNIAILTPLLGLTWGFGVATVIDDRSLAFHIIFSLLNAFQGFFILVFGTILDPKIREALKG

SEQ ID NO: 2992 - protein, 640 aa, Homo sapiens
  Payload ID: 684;
  Gene Symbol: ADGRF2;
  Gene Name: adhesion G prt-coupled receptor F2;
  ENSP ID: ENSP00000422934
MTHILLLYYLVFLLPTESCRTLYQAASKSKEKVPARPHGVCDGVCTDYSQCTQPCPPDTQGNMGFSCRQKTWHKITDTCQTLNALNIFEEDSRLVQPFEDNIKISVYTGKSETITDMLLQKCPTDLSCVIRNIQQSPWIPGNIAVIVQLLHNISTAIWTGVDEAKMQSYSTIANHILNSKSISNWTFIPDRNSSYILLHSVNSFARRLFIDKHPVDISDVFIHTMGTTISGDNIGKNFTFSMRINDTSNEVTGRVLISRDELRKVPSPSQVISIAFPTIGAILEASLLENVTVNGLVLSAILPKELKRISLIFEKISKSEERRTQCVGWHSVENRWDQQACKMIQENSQQAVCKCRPSKLFTSFSILMSPHILESLILTYITYVGLGISICSLILCLSIEVLVWSQVTKTEITYLRHVCIVNIAATLLMADVWFIVASFLSGPITHHKGCVAATFFVHFFYLSVFFWMLAKALLILYGIMIVFHTLPKSVLVASLFSVGYGCPLAIAAITVAATEPGKGYLRPEICWLNWDMTKALLAFVIPALAIVVVNLITVTLVIVKTQRAAIGNSMFQEVRAIVRISKNIAILTPLLGLTWGFGVATVIDDRSLAFHIIFSLLNAFQVSPDASDQVQSERIHEDVL

SEQ ID NO: 2993 - protein, 642 aa, Homo sapiens; identical to SEQ ID NO: 2991
  Payload ID: 684;
  Gene Symbol: ADGRF2;
  Gene Name: adhesion G prt-coupled receptor F2;
  Uniprot ID:  Q8IZF7;
  ENSP ID: ENSP00000425269

SEQ ID NO: 2994 - protein, 1079 aa, Homo sapiens
  Payload ID: 685;
  Gene Symbol: ADGRF3;
  Gene Name: adhesion G prt-coupled receptor F3;
  Uniprot ID:  Q8IZF5;
  ENSP ID: ENSP00000307831
MVCSAAPLLLLATTLPLLGSPVAQASQPVSETGVRPREGLQRRQWGPLIGRDKAWNERIDRPFPACPIPLSSSFGRWPKGQTMWAQTSTLTLTEEELGQSQAGGESGSGQLLDQENGAGESALVSVYVHLDFPDKTWPPELSRTLTLPAASASSSPRPLLTGLRLTTECNVNHKGNFYCACLSGYQWNTSICLHYPPCQSLHNHQPCGCLVFSHPEPGYCQLLPPGSPVTCLPAVPGILNLNSQLQMPGDTLSLTLHLSQEATNLSWFLRHPGSPSPILLQPGTQVSVTSSHGQAALSVSNMSHHWAGEYMSCFEAQGFKWNLYEVVRVPLKATDVARLPYQLSISCATSPGFQLSCCIPSTNLAYTAAWSPGEGSKASSFNESGSQCFVLAVQRCPMADTTYACDLQSLGLAPLRVPISITIIQDGDITCPEDASVLTWNVTKAGHVAQAPCPESKRGIVRRLCGADGVWGPVHSSCTDARLLALFTRTKLLQAGQGSPAEEVPQILAQLPGQAAEASSPSDLLTLLSTMKYVAKVVAEARIQLDRRALKNLLIATDKVLDMDTRSLWTLAQARKPWAGSTLLLAVETLACSLCPQDHPFAFSLPNVLLQSQLFGPTFPADYSISFPTRPPLQAQIPRHSLAPLVRNGTEISITSLVLRKLDHLLPSNYGQGLGDSLYATPGLVLVISIMAGDRAFSQGEVIMDFGNTDGSPHCVFWDHSLFQGRGGWSKEGCQAQVASASPTAQCLCQHLTAFSVLMSPHTVPEEPALALLTQVGLGASILALLVCLGVYWLVWRVVVRNKISYFRHAALLNMVFCLLAADTCFLGAPFLSPGPRSPLCLAAAFLCHFLYLATFFWMLAQALVLAHQLLFVFHQLAKHRVLPLMVLLGYLCPLGLAGVTLGLYLPQGQYLREGECWLDGKGGALYTFVGPVLAIIGVNGLVLAMAMLKLLRPSLSEGPPAEKRQALLGVIKALLILTPIFGLTWGLGLATLLEEVSTVPHYIFTILNTLQGVFILLFGCLMDRKIQEALRKRFCRAQAPSSTISLVSCCLQILSCASKSMSEGIPWPSSEDMGTARS

SEQ ID NO: 2995 - protein, 873 aa, Homo sapiens
  Payload ID: 685;
  Gene Symbol: ADGRF3;
  Gene Name: adhesion G prt-coupled receptor F3;
  Uniprot ID:  Q8IZF5;
  ENSP ID: ENSP00000327396
MTTRKLSAHSAATPGYKAVTHKHHTGWARMAKTGLPEKGQSQAGGESGSGQLLDQENGAGESALVSVYVHLDFPDKTWPPELSRTLTLPAASASSSPRPLLTGLRLTTGEYMSCFEAQGFKWNLYEVVRVPLKATDVARLPYQLSISCATSPGFQLSCCIPSTNLAYTAAWSPGEGSKASSFNESGSQCFVLAVQRCPMADTTYACDLQSLGLAPLRVPISITIIQDGDITCPEDASVLTWNVTKAGHVAQAPCPESKRGIVRRLCGADGVWGPVHSSCTDARLLALFTRTKLLQAGQGSPAEEVPQILAQLPGQAAEASSPSDLLTLLSTMKYVAKVVAEARIQLDRRALKNLLIATDKVLDMDTRSLWTLAQARKPWAGSTLLLAVETLACSLCPQDHPFAFSLPNVLLQSQLFGPTFPADYSISFPTRPPLQAQIPRHSLAPLVRNGTEISITSLVLRKLDHLLPSNYGQGLGDSLYATPGLVLVISIMAGDRAFSQGEVIMDFGNTDGSPHCVFWDHSLFQGRGGWSKEGCQAQVASASPTAQCLCQHLTAFSVLMSPHTVPEEPALALLTQVGLGASILALLVCLGVYWLVWRVVVRNKISYFRHAALLNMVFCLLAADTCFLGAPFLSPGPRSPLCLAAAFLCHFLYLATFFWMLAQALVLAHQLLFVFHQLAKHRVLPLMVLLGYLCPLGLAGVTLGLYLPQGQYLREGECWLDGKGGALYTFVGPVLAIIGVNGLVLAMAMLKLLRPSLSEGPPAEKRQALLGVIKALLILTPIFGLTWGLGLATLLEEVSTVPHYIFTILNTLQGVFILLFGCLMDRKIQEALRKRFCRAQAPSSTISLATNEGCILEHSKGGSDTARKTDASE

SEQ ID NO: 2996 - protein, 997 aa, Homo sapiens
  Payload ID: 685;
  Gene Symbol: ADGRF3;
  Gene Name: adhesion G prt-coupled receptor F3;
  Uniprot ID:  Q8IZF5;
  ENSP ID: ENSP00000388537
MVCSAAPLLLLATTLPLLGSPVAQASQPGQSQAGGESGSGQLLDQENGAGESALVSVYVHLDFPDKTWPPELSRTLTLPAASASSSPRPLLTGLRLTTECNVNHKGNFYCACLSGYQWNTSICLHYPPCQSLHNHQPCGCLVFSHPEPGYCQLLPPGSPVTCLPAVPGILNLNSQLQMPGDTLSLTLHLSQEATNLSWFLRHPGSPSPILLQPGTQVSVTSSHGQAALSVSNMSHHWAGEYMSCFEAQGFKWNLYEVVRVPLKATDVARLPYQLSISCATSPGFQLSCCIPSTNLAYTAAWSPGEGSKASSFNESGSQCFVLAVQRCPMADTTYACDLQSLGLAPLRVPISITIIQDGDITCPEDASVLTWNVTKAGHVAQAPCPESKRGIVRRLCGADGVWGPVHSSCTDARLLALFTRTKLLQAGQGSPAEEVPQILAQLPGQAAEASSPSDLLTLLSTMKYVAKVVAEARIQLDRRALKNLLIATDKVLDMDTRSLWTLAQARKPWAGSTLLLAVETLACSLCPQDHPFAFSLPNVLLQSQLFGPTFPADYSISFPTRPPLQAQIPRHSLAPLVRNGTEISITSLVLRKLDHLLPSNYGQGLGDSLYATPGLVLVISIMAGDRAFSQGEVIMDFGNTDGSPHCVFWDHSLFQGRGGWSKEGCQAQVASASPTAQCLCQHLTAFSVLMSPHTVPEEPALALLTQVGLGASILALLVCLGVYWLVWRVVVRNKISYFRHAALLNMVFCLLAADTCFLGAPFLSPGPRSPLCLAAAFLCHFLYLATFFWMLAQALVLAHQLLFVFHQLAKHRVLPLMVLLGYLCPLGLAGVTLGLYLPQGQYLREGECWLDGKGGALYTFVGPVLAIIGVNGLVLAMAMLKLLRPSLSEGPPAEKRQALLGVIKALLILTPIFGLTWGLGLATLLEEVSTVPHYIFTILNTLQGVFILLFGCLMDRKIQEALRKRFCRAQAPSSTISLATNEGCILEHSKGGSDTAR

SEQ ID NO: 2997 - protein, 120 aa, Homo sapiens
  Payload ID: 685;
  Gene Symbol: ADGRF3;
  Gene Name: adhesion G prt-coupled receptor F3;
  ENSP ID: ENSP00000394162
MTTRKLSAHSAATPGYKAVTHKHHTGWARMAKTGLPEKLPPSTSQALSALCWLFSAARWLTPRTLVTCRAWAWLHSGSPSPSPSSRMETSPALRTPRCSPGMSPRLATWHRPHVLRARGA

SEQ ID NO: 2998 - protein, 873 aa, Homo sapiens; identical to SEQ ID NO: 2995
  Payload ID: 685;
  Gene Symbol: ADGRF3;
  Gene Name: adhesion G prt-coupled receptor F3;
  Uniprot ID:  Q8IZF5;
  ENSP ID: ENSP00000404775

SEQ ID NO: 2999 - protein, 87 aa, Homo sapiens
  Payload ID: 685;
  Gene Symbol: ADGRF3;
  Gene Name: adhesion G prt-coupled receptor F3;
  ENSP ID: ENSP00000409595
MTTRKLSAHSAATPGYKAVTHKHHTGWARMAKTGLPEKGQSQAGGESGSGQLLDQENGAGESALVSVYVHLDFPDKTWPPELSRTLT

SEQ ID NO: 3000 - protein, 695 aa, Homo sapiens
  Payload ID: 686;
  Gene Symbol: ADGRF4;
  Gene Name: adhesion G prt-coupled receptor F4;
  Uniprot ID:  Q8IZF3;
  ENSP ID: ENSP00000283303
MKMKSQATMICCLVFFLSTECSHYRSKIHLKAGDKLQSPEGKPKTGRIQEKCEGPCISSSNCSQPCAKDFHGEIGFTCNQKKWQKSAETCTSLSVEKLFKDSTGASRLSVAAPSIPLHILDFRAPETIESVAQGIRKNCPFDYACITDMVKSSETTSGNIAFIVELLKNISTDLSDNVTREKMKSYSEVANHILDTAAISNWAFIPNKNASSDLLQSVNLFARQLHIHNNSENIVNELFIQTKGFHINHNTSEKSLNFSMSMNNTTEDILGMVQIPRQELRKLWPNASQAISIAFPTLGAILREAHLQNVSLPRQVNGLVLSVVLPERLQEIILTFEKINKTRNARAQCVGWHSKKRRWDEKACQMMLDIRNEVKCRCNYTSVVMSFSILMSSKSMTDKVLDYITCIGLSVSILSLVLCLIIEATVWSRVVVTEISYMRHVCIVNIAVSLLTANVWFIIGSHFNIKAQDYNMCVAVTFFSHFFYLSLFFWMLFKALLIIYGILVIFRRMMKSRMMVIGFAIGYGCPLIIAVTTVAITEPEKGYMRPEACWLNWDNTKALLAFAIPAFVIVAVNLIVVLVVAVNTQRPSIGSSKSQDVVIIMRISKNVAILTPLLGLTWGFGIATLIEGTSLTFHIIFALLNAFQGFFILLFGTIMDHKIRDALRMRMSSLKGKSRAAENASLGPTNGSKLMNRQG

SEQ ID NO: 3001 - protein, 695 aa, Homo sapiens; identical to SEQ ID NO: 3000
  Payload ID: 686;
  Gene Symbol: ADGRF4;
  Gene Name: adhesion G prt-coupled receptor F4;
  Uniprot ID:  Q8IZF3;
  ENSP ID: ENSP00000328319

SEQ ID NO: 3002 - protein, 752 aa, Homo sapiens
  Payload ID: 686;
  Gene Symbol: ADGRF4;
  Gene Name: adhesion G prt-coupled receptor F4;
  ENSP ID: ENSP00000360264
MYTGPCKVLHLSSGLLPNSGRFGIVLSDEYQVVTSLWCQLYTTHAPQQASGMLLLNYLVIPSKAQVNKPGYIPNLGECSHYRSKIHLKAGDKLQSPEGKPKTGRIQEKCEGPCISSSNCSQPCAKDFHGEIGFTCNQKKWQKSAETCTSLSVEKLFKDSTGASRLSVAAPSIPLHILDFRAPETIESVAQGIRKNCPFDYACITDMVKSSETTSGNIAFIVELLKNISTDLSDNVTREKMKSYSEVANHILDTAAISNWAFIPNKNASSDLLQSVNLFARQLHIHNNSENIVNELFIQTKGFHINHNTSEKSLNFSMSMNNTTEDILGMVQIPRQELRKLWPNASQAISIAFPTLGAILREAHLQNVSLPRQVNGLVLSVVLPERLQEIILTFEKINKTRNARAQCVGWHSKKRRWDEKACQMMLDIRNEVKCRCNYTSVVMSFSILMSSKSMTDKVLDYITCIGLSVSILSLVLCLIIEATVWSRVVVTEISYMRHVCIVNIAVSLLTANVWFIIGSHFNIKAQDYNMCVAVTFFSHFFYLSLFFWMLFKALLIIYGILVIFRRMMKSRMMVIGFAIGYGCPLIIAVTTVAITEPEKGYMRPEACWLNWDNTKALLAFAIPAFVIVAVNLIVVLVVAVNTQRPSIGSSKSQDVVIIMRISKNVAILTPLLGLTWGFGIATLIEGTSLTFHIIFALLNAFQGFFILLFGTIMDHKIRDALRMRMSSLKGKSRAAENASLGPTNGSKLMNRQG

SEQ ID NO: 3003 - protein, 1346 aa, Homo sapiens
  Payload ID: 687;
  Gene Symbol: ADGRF5;
  Gene Name: adhesion G prt-coupled receptor F5;
  Uniprot ID:  Q8IZF2;
  ENSP ID: ENSP00000265417
MKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTVCRPAGNEIWCSCETGYGWPRERCLHNLICQERDVFLPGHHCSCLKELPPNGPFCLLQEDVTLNMRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTINESNFFVTPEIIFEGDTVSLVCEKEVLSSNVSWRYEEQQLEIQNSSRFSIYTALFNNMTSVSKLTIHNITPGDAGEYVCKLILDIFEYECKKKIDVMPIQILANEEMKVMCDNNPVSLNCCSQGNVNWSKVEWKQEGKINIPGTPETDIDSSCSRYTLKADGTQCPSGSSGTTVIYTCEFISAYGARGSANIKVTFISVANLTITPDPISVSEGQNFSIKCISDVSNYDEVYWNTSAGIKIYQRFYTTRRYLDGAESVLTVKTSTREWNGTYHCIFRYKNSYSIATKDVIVHPLPLKLNIMVDPLEATVSCSGSHHIKCCIEEDGDYKVTFHTGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSMVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTGTYNVSTPEATSSSLENSSSASSLLN

SEQ ID NO: 3004 - protein, 1346 aa, Homo sapiens; identical to SEQ ID NO: 3003
  Payload ID: 687;
  Gene Symbol: ADGRF5;
  Gene Name: adhesion G prt-coupled receptor F5;
  Uniprot ID:  Q8IZF2;
  ENSP ID: ENSP00000283296

SEQ ID NO: 3005 - protein, 687 aa, Homo sapiens
  Payload ID: 688;
  Gene Symbol: ADGRG1;
  Gene Name: adhesion G prt-coupled receptor G1;
  Uniprot ID:  Q9Y653;
  ENSP ID: ENSP00000373465
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 3006 - protein, 692 aa, Homo sapiens
  Payload ID: 688;
  Gene Symbol: ADGRG1;
  Gene Name: adhesion G prt-coupled receptor G1;
  Uniprot ID:  Q9Y653;
  ENSP ID: ENSP00000398034
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 3007 - protein, 687 aa, Homo sapiens; identical to SEQ ID NO: 3005
  Payload ID: 688;
  Gene Symbol: ADGRG1;
  Gene Name: adhesion G prt-coupled receptor G1;
  Uniprot ID:  Q9Y653;
  ENSP ID: ENSP00000444911

SEQ ID NO: 3008 - protein, 94 aa, Homo sapiens
  Payload ID: 688;
  Gene Symbol: ADGRG1;
  Gene Name: adhesion G prt-coupled receptor G1;
  ENSP ID: ENSP00000454233
MTPQSLLQTTLFLLSLLFLVQGAHGRGHREDFRFCSQRNQTHRSSLHYKPTPDLRISIENSEEALTVHAPFPAAHPASRSFPDPRGLYHFCLYW

SEQ ID NO: 3009 - protein, 125 aa, Homo sapiens
  Payload ID: 688;
  Gene Symbol: ADGRG1;
  Gene Name: adhesion G prt-coupled receptor G1;
  ENSP ID: ENSP00000454263
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLL

SEQ ID NO: 3010 - protein, 131 aa, Homo sapiens
  Payload ID: 688;
  Gene Symbol: ADGRG1;
  Gene Name: adhesion G prt-coupled receptor G1;
  ENSP ID: ENSP00000454289
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQ

SEQ ID NO: 3011 - protein, 81 aa, Homo sapiens
  Payload ID: 688;
  Gene Symbol: ADGRG1;
  Gene Name: adhesion G prt-coupled receptor G1;
  ENSP ID: ENSP00000454321
MTPQSLLQTTLFLLSLLFLVQGRCPRQGPQGRLSLLQPAEPDTQEQPPLQTHTRPAHLHRELRRGPHSPCPFPCSPPCFPI

SEQ ID NO: 3012 - protein, 119 aa, Homo sapiens
  Payload ID: 688;
  Gene Symbol: ADGRG1;
  Gene Name: adhesion G prt-coupled receptor G1;
  ENSP ID: ENSP00000454364
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSL

SEQ ID NO: 3013 - protein, 6 aa, Homo sapiens
  Payload ID: 688;
  Gene Symbol: ADGRG1;
  Gene Name: adhesion G prt-coupled receptor G1;
  ENSP ID: ENSP00000454490
MTPQSL

SEQ ID NO: 3014 - protein, 97 aa, Homo sapiens
  Payload ID: 688;
  Gene Symbol: ADGRG1;
  Gene Name: adhesion G prt-coupled receptor G1;
  ENSP ID: ENSP00000454574
MTPQSLLQTTLFLLSLLFLVQASGTRHTGAASTTNPHQTCASPSRTPKRPSQSMPLSLQPTLLPDPSLTPGASTTSASTGTDMLGDYIFSMASVTSC

SEQ ID NO: 3015 - protein, 146 aa, Homo sapiens
  Payload ID: 688;
  Gene Symbol: ADGRG1;
  Gene Name: adhesion G prt-coupled receptor G1;
  ENSP ID: ENSP00000454607
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVT

SEQ ID NO: 3016 - protein, 97 aa, Homo sapiens
  Payload ID: 688;
  Gene Symbol: ADGRG1;
  Gene Name: adhesion G prt-coupled receptor G1;
  ENSP ID: ENSP00000454779
MTPQSLLQTTLFLLSLLFLVQGSGTRHTGAASTTNPHQTCASPSRTPKRPSQSMPLSLQPTLLPDPSLTPGASTTSASTGTDMLGDYIFSMASVTSC

SEQ ID NO: 3017 - protein, 198 aa, Homo sapiens
  Payload ID: 688;
  Gene Symbol: ADGRG1;
  Gene Name: adhesion G prt-coupled receptor G1;
  ENSP ID: ENSP00000454855
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHP

SEQ ID NO: 3018 - protein, 97 aa, Homo sapiens; identical to SEQ ID NO: 3014
  Payload ID: 688;
  Gene Symbol: ADGRG1;
  Gene Name: adhesion G prt-coupled receptor G1;
  ENSP ID: ENSP00000454879

SEQ ID NO: 3019 - protein, 94 aa, Homo sapiens; identical to SEQ ID NO: 3008
  Payload ID: 688;
  Gene Symbol: ADGRG1;
  Gene Name: adhesion G prt-coupled receptor G1;
  ENSP ID: ENSP00000454933

SEQ ID NO: 3020 - protein, 116 aa, Homo sapiens
  Payload ID: 688;
  Gene Symbol: ADGRG1;
  Gene Name: adhesion G prt-coupled receptor G1;
  ENSP ID: ENSP00000455074
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKA

SEQ ID NO: 3021 - protein, 168 aa, Homo sapiens
  Payload ID: 688;
  Gene Symbol: ADGRG1;
  Gene Name: adhesion G prt-coupled receptor G1;
  ENSP ID: ENSP00000455176
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHS

SEQ ID NO: 3022 - protein, 78 aa, Homo sapiens
  Payload ID: 688;
  Gene Symbol: ADGRG1;
  Gene Name: adhesion G prt-coupled receptor G1;
  ENSP ID: ENSP00000455209
MTPQSLLQTTLFLLSLLFLVQGRCPRQGPQGRLSLLQPAEPDTQEQPPLQTHTRPAHLHRELRRGPHSPCPFPCSPPC

SEQ ID NO: 3023 - protein, 693 aa, Homo sapiens
  Payload ID: 688;
  Gene Symbol: ADGRG1;
  Gene Name: adhesion G prt-coupled receptor G1;
  Uniprot ID:  Q9Y653;
  ENSP ID: ENSP00000455215
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 3024 - protein, 98 aa, Homo sapiens
  Payload ID: 688;
  Gene Symbol: ADGRG1;
  Gene Name: adhesion G prt-coupled receptor G1;
  ENSP ID: ENSP00000455226
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLY

SEQ ID NO: 3025 - protein, 97 aa, Homo sapiens; identical to SEQ ID NO: 3016
  Payload ID: 688;
  Gene Symbol: ADGRG1;
  Gene Name: adhesion G prt-coupled receptor G1;
  ENSP ID: ENSP00000455245

SEQ ID NO: 3026 - protein, 687 aa, Homo sapiens; identical to SEQ ID NO: 3005
  Payload ID: 688;
  Gene Symbol: ADGRG1;
  Gene Name: adhesion G prt-coupled receptor G1;
  Uniprot ID:  Q9Y653;
  ENSP ID: ENSP00000455351

SEQ ID NO: 3027 - protein, 95 aa, Homo sapiens
  Payload ID: 688;
  Gene Symbol: ADGRG1;
  Gene Name: adhesion G prt-coupled receptor G1;
  ENSP ID: ENSP00000455553
MTPQSLLQTTLFLLSLLFLVQAHPASRSFPDPRGLYHFCLYWNRHAGRLHLLYGKRDFLLSDKASSLLCFQHQEESLAQGPPLLATSVTSWWSPQ

SEQ ID NO: 3028 - protein, 167 aa, Homo sapiens
  Payload ID: 688;
  Gene Symbol: ADGRG1;
  Gene Name: adhesion G prt-coupled receptor G1;
  ENSP ID: ENSP00000455600
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHT

SEQ ID NO: 3029 - protein, 90 aa, Homo sapiens
  Payload ID: 688;
  Gene Symbol: ADGRG1;
  Gene Name: adhesion G prt-coupled receptor G1;
  ENSP ID: ENSP00000455812
MTPQSLLQTTLFLLSLLFLVQASASSGAHGRGHREDFRFCSQRNQTHRSSLHYKPTPDLRISIENSEEALTVHAPFPAAHPASRSFPDPR

SEQ ID NO: 3030 - protein, 54 aa, Homo sapiens
  Payload ID: 688;
  Gene Symbol: ADGRG1;
  Gene Name: adhesion G prt-coupled receptor G1;
  ENSP ID: ENSP00000455965
MTPQSLLQTTLFLLSLLFLVQGAHGRGHREDFRFCSQRNQTHRSSLHYKPTPDL

SEQ ID NO: 3031 - protein, 159 aa, Homo sapiens
  Payload ID: 688;
  Gene Symbol: ADGRG1;
  Gene Name: adhesion G prt-coupled receptor G1;
  ENSP ID: ENSP00000456002
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTF

SEQ ID NO: 3032 - protein, 111 aa, Homo sapiens
  Payload ID: 688;
  Gene Symbol: ADGRG1;
  Gene Name: adhesion G prt-coupled receptor G1;
  ENSP ID: ENSP00000456147
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFL

SEQ ID NO: 3033 - protein, 70 aa, Homo sapiens
  Payload ID: 688;
  Gene Symbol: ADGRG1;
  Gene Name: adhesion G prt-coupled receptor G1;
  ENSP ID: ENSP00000456166
MTPQSLLQTTLFLLSLLFLVQGAHGRGHREDFRFCSQRNQTHRSSLHYKPTPDLRISIENSEEALTVHAP

SEQ ID NO: 3034 - protein, 256 aa, Homo sapiens
  Payload ID: 688;
  Gene Symbol: ADGRG1;
  Gene Name: adhesion G prt-coupled receptor G1;
  ENSP ID: ENSP00000456238
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQE

SEQ ID NO: 3035 - protein, 118 aa, Homo sapiens
  Payload ID: 688;
  Gene Symbol: ADGRG1;
  Gene Name: adhesion G prt-coupled receptor G1;
  ENSP ID: ENSP00000456256
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLS

SEQ ID NO: 3036 - protein, 154 aa, Homo sapiens
  Payload ID: 688;
  Gene Symbol: ADGRG1;
  Gene Name: adhesion G prt-coupled receptor G1;
  ENSP ID: ENSP00000456263
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSA

SEQ ID NO: 3037 - protein, 167 aa, Homo sapiens; identical to SEQ ID NO: 3028
  Payload ID: 688;
  Gene Symbol: ADGRG1;
  Gene Name: adhesion G prt-coupled receptor G1;
  ENSP ID: ENSP00000456362

SEQ ID NO: 3038 - protein, 140 aa, Homo sapiens
  Payload ID: 688;
  Gene Symbol: ADGRG1;
  Gene Name: adhesion G prt-coupled receptor G1;
  ENSP ID: ENSP00000456469
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSV

SEQ ID NO: 3039 - protein, 42 aa, Homo sapiens
  Payload ID: 688;
  Gene Symbol: ADGRG1;
  Gene Name: adhesion G prt-coupled receptor G1;
  ENSP ID: ENSP00000456494
MTPQSLLQTTLFLLSLLFLVQGAHGRGHREDFRFCSQRNQTH

SEQ ID NO: 3040 - protein, 118 aa, Homo sapiens
  Payload ID: 688;
  Gene Symbol: ADGRG1;
  Gene Name: adhesion G prt-coupled receptor G1;
  ENSP ID: ENSP00000456544
MTPQSLLQTTLFLLSLLFLVQAPATGSHLQPLPPQVPTAGATGKTFASAASGTRHTGAASTTNPHQTCASPSRTPKRPSQSMPLSLQPTLLPDPSLTPGASTTSASTGTDMLGDYIFS

SEQ ID NO: 3041 - protein, 131 aa, Homo sapiens; identical to SEQ ID NO: 3010
  Payload ID: 688;
  Gene Symbol: ADGRG1;
  Gene Name: adhesion G prt-coupled receptor G1;
  ENSP ID: ENSP00000456599

SEQ ID NO: 3042 - protein, 90 aa, Homo sapiens
  Payload ID: 688;
  Gene Symbol: ADGRG1;
  Gene Name: adhesion G prt-coupled receptor G1;
  ENSP ID: ENSP00000456603
MTPQSLLQTTLFLLSLLFLVQAPATGSHLQPLPPQVPTAGATGKTFASAASGTRHTGAASTTNPHQTCASPSRTPKRPSQSMPLSLQPTL

SEQ ID NO: 3043 - protein, 687 aa, Homo sapiens; identical to SEQ ID NO: 3005
  Payload ID: 688;
  Gene Symbol: ADGRG1;
  Gene Name: adhesion G prt-coupled receptor G1;
  Uniprot ID:  Q9Y653;
  ENSP ID: ENSP00000456620

SEQ ID NO: 3044 - protein, 116 aa, Homo sapiens; identical to SEQ ID NO: 3020
  Payload ID: 688;
  Gene Symbol: ADGRG1;
  Gene Name: adhesion G prt-coupled receptor G1;
  ENSP ID: ENSP00000456632

SEQ ID NO: 3045 - protein, 125 aa, Homo sapiens
  Payload ID: 688;
  Gene Symbol: ADGRG1;
  Gene Name: adhesion G prt-coupled receptor G1;
  ENSP ID: ENSP00000456682
MTPQSLLQTTLFLLSLLFLVQAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMC

SEQ ID NO: 3046 - protein, 187 aa, Homo sapiens
  Payload ID: 688;
  Gene Symbol: ADGRG1;
  Gene Name: adhesion G prt-coupled receptor G1;
  ENSP ID: ENSP00000456731
  MOD_RES (1)..(1): Any amino acid
XSVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVFGTYVPGYLLKLSAMGWGFPIFLVTLVALVDVDNYGPIILAVHRTP

SEQ ID NO: 3047 - protein, 49 aa, Homo sapiens
  Payload ID: 688;
  Gene Symbol: ADGRG1;
  Gene Name: adhesion G prt-coupled receptor G1;
  ENSP ID: ENSP00000456781
MTPQSLLQTTLFLLSLLFLVQGAHGRGHREDFRFCSQRNQTHRSSLHYK

SEQ ID NO: 3048 - protein, 107 aa, Homo sapiens
  Payload ID: 688;
  Gene Symbol: ADGRG1;
  Gene Name: adhesion G prt-coupled receptor G1;
  ENSP ID: ENSP00000456787
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGK

SEQ ID NO: 3049 - protein, 693 aa, Homo sapiens; identical to SEQ ID NO: 3023
  Payload ID: 688;
  Gene Symbol: ADGRG1;
  Gene Name: adhesion G prt-coupled receptor G1;
  Uniprot ID:  Q9Y653;
  ENSP ID: ENSP00000456794

SEQ ID NO: 3050 - protein, 103 aa, Homo sapiens
  Payload ID: 688;
  Gene Symbol: ADGRG1;
  Gene Name: adhesion G prt-coupled receptor G1;
  ENSP ID: ENSP00000456796
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHA

SEQ ID NO: 3051 - protein, 77 aa, Homo sapiens
  Payload ID: 688;
  Gene Symbol: ADGRG1;
  Gene Name: adhesion G prt-coupled receptor G1;
  ENSP ID: ENSP00000456819
MTPQSLLQTTLFLLSLLFLVQGAHGRGHREDFRFCSQRNQTHRSSLHYKPTPDLRISIENSEEALTVHAPFPAAHPA

SEQ ID NO: 3052 - protein, 118 aa, Homo sapiens; identical to SEQ ID NO: 3035
  Payload ID: 688;
  Gene Symbol: ADGRG1;
  Gene Name: adhesion G prt-coupled receptor G1;
  ENSP ID: ENSP00000457063

SEQ ID NO: 3053 - protein, 113 aa, Homo sapiens
  Payload ID: 688;
  Gene Symbol: ADGRG1;
  Gene Name: adhesion G prt-coupled receptor G1;
  ENSP ID: ENSP00000457073
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLS

SEQ ID NO: 3054 - protein, 56 aa, Homo sapiens
  Payload ID: 688;
  Gene Symbol: ADGRG1;
  Gene Name: adhesion G prt-coupled receptor G1;
  ENSP ID: ENSP00000457122
MTPQSLLQTTLFLLSLLFLVQGAHGRGHREDFRFCSQRNQTHRSSLHYKPTPDLRI

SEQ ID NO: 3055 - protein, 84 aa, Homo sapiens
  Payload ID: 688;
  Gene Symbol: ADGRG1;
  Gene Name: adhesion G prt-coupled receptor G1;
  ENSP ID: ENSP00000457143
MTPQSLLQTTLFLLSLLFLVQGAHGRGHREDFRFCSQRNQTHRSSLHYKPTPDLRISIENSEEALTVHAPFPAAHPASRSFPDP

SEQ ID NO: 3056 - protein, 153 aa, Homo sapiens
  Payload ID: 688;
  Gene Symbol: ADGRG1;
  Gene Name: adhesion G prt-coupled receptor G1;
  ENSP ID: ENSP00000457178
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPS

SEQ ID NO: 3057 - protein, 100 aa, Homo sapiens
  Payload ID: 688;
  Gene Symbol: ADGRG1;
  Gene Name: adhesion G prt-coupled receptor G1;
  ENSP ID: ENSP00000457223
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGR

SEQ ID NO: 3058 - protein, 118 aa, Homo sapiens
  Payload ID: 688;
  Gene Symbol: ADGRG1;
  Gene Name: adhesion G prt-coupled receptor G1;
  ENSP ID: ENSP00000457307
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASS

SEQ ID NO: 3059 - protein, 687 aa, Homo sapiens; identical to SEQ ID NO: 3005
  Payload ID: 688;
  Gene Symbol: ADGRG1;
  Gene Name: adhesion G prt-coupled receptor G1;
  Uniprot ID:  Q9Y653;
  ENSP ID: ENSP00000457456

SEQ ID NO: 3060 - protein, 97 aa, Homo sapiens; identical to SEQ ID NO: 3014
  Payload ID: 688;
  Gene Symbol: ADGRG1;
  Gene Name: adhesion G prt-coupled receptor G1;
  ENSP ID: ENSP00000457612

SEQ ID NO: 3061 - protein, 122 aa, Homo sapiens
  Payload ID: 688;
  Gene Symbol: ADGRG1;
  Gene Name: adhesion G prt-coupled receptor G1;
  ENSP ID: ENSP00000457635
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCF

SEQ ID NO: 3062 - protein, 114 aa, Homo sapiens
  Payload ID: 688;
  Gene Symbol: ADGRG1;
  Gene Name: adhesion G prt-coupled receptor G1;
  ENSP ID: ENSP00000457657
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRD

SEQ ID NO: 3063 - protein, 164 aa, Homo sapiens
  Payload ID: 688;
  Gene Symbol: ADGRG1;
  Gene Name: adhesion G prt-coupled receptor G1;
  ENSP ID: ENSP00000457806
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTF

SEQ ID NO: 3064 - protein, 199 aa, Homo sapiens
  Payload ID: 688;
  Gene Symbol: ADGRG1;
  Gene Name: adhesion G prt-coupled receptor G1;
  ENSP ID: ENSP00000457953
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRR

SEQ ID NO: 3065 - protein, 110 aa, Homo sapiens
  Payload ID: 688;
  Gene Symbol: ADGRG1;
  Gene Name: adhesion G prt-coupled receptor G1;
  ENSP ID: ENSP00000457979
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDF

SEQ ID NO: 3066 - protein, 68 aa, Homo sapiens
  Payload ID: 688;
  Gene Symbol: ADGRG1;
  Gene Name: adhesion G prt-coupled receptor G1;
  ENSP ID: ENSP00000457994
MTPQSLLQTTLFLLSLLFLVQASSLLCFQHQEESLAQGPPLLATSVTSWWSPQNISLPSAASFTFSFH

SEQ ID NO: 3067 - protein, 144 aa, Homo sapiens
  Payload ID: 688;
  Gene Symbol: ADGRG1;
  Gene Name: adhesion G prt-coupled receptor G1;
  ENSP ID: ENSP00000458014
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATS

SEQ ID NO: 3068 - protein, 162 aa, Homo sapiens
  Payload ID: 688;
  Gene Symbol: ADGRG1;
  Gene Name: adhesion G prt-coupled receptor G1;
  ENSP ID: ENSP00000458063
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFH

SEQ ID NO: 3069 - protein, 84 aa, Homo sapiens; identical to SEQ ID NO: 3055
  Payload ID: 688;
  Gene Symbol: ADGRG1;
  Gene Name: adhesion G prt-coupled receptor G1;
  ENSP ID: ENSP00000458087

SEQ ID NO: 3070 - protein, 898 aa, Homo sapiens
  Payload ID: 689;
  Gene Symbol: ADGRG2;
  Gene Name: adhesion G prt-coupled receptor G2;
  Uniprot ID:  Q8IZP9;
  ENSP ID: ENSP00000344972
MVFSVRQCGHVGRTEEVLLTFKIFLVIICLHVVLVTSLEEDTDNSSLSPPPEVETTSLNDVTLSLLPSNETGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 3071 - protein, 898 aa, Homo sapiens; identical to SEQ ID NO: 3070
  Payload ID: 689;
  Gene Symbol: ADGRG2;
  Gene Name: adhesion G prt-coupled receptor G2;
  Uniprot ID:  Q8IZP9;
  ENSP ID: ENSP00000346845

SEQ ID NO: 3072 - protein, 1003 aa, Homo sapiens
  Payload ID: 689;
  Gene Symbol: ADGRG2;
  Gene Name: adhesion G prt-coupled receptor G2;
  Uniprot ID:  Q8IZP9;
  ENSP ID: ENSP00000349015
MVFSVRQCGHVGRTEEVLLTFKIFLVIICLHVVLVTSLEEDTDNSSLSPPPAKLSVVSFAPSSNGTPEVETTSLNDVTLSLLPSNETGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 3073 - protein, 987 aa, Homo sapiens
  Payload ID: 689;
  Gene Symbol: ADGRG2;
  Gene Name: adhesion G prt-coupled receptor G2;
  Uniprot ID:  Q8IZP9;
  ENSP ID: ENSP00000350152
MVFSVRQCGHVGRTEEVLLTFKIFLVIICLHVVLVTSLEEDTDNSSLSPPPEVETTSLNDVTLSLLPSNETGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 3074 - protein, 1014 aa, Homo sapiens
  Payload ID: 689;
  Gene Symbol: ADGRG2;
  Gene Name: adhesion G prt-coupled receptor G2;
  Uniprot ID:  Q8IZP9;
  ENSP ID: ENSP00000350680
MVFSVRQCGHVGRTEEVLLTFKIFLVIICLHVVLVTSLEEDTDNSSLSPPPAKLSVVSFAPSSNEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 3075 - protein, 995 aa, Homo sapiens
  Payload ID: 689;
  Gene Symbol: ADGRG2;
  Gene Name: adhesion G prt-coupled receptor G2;
  Uniprot ID:  Q8IZP9;
  ENSP ID: ENSP00000353421
MVFSVRQCGHVGRTEEVLLTFKIFLVIICLHVVLVTSLEEDTDNSSLSPPPAKLSVVSFAPSSNGTPDVTLSLLPSNETGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 3076 - protein, 1017 aa, Homo sapiens
  Payload ID: 689;
  Gene Symbol: ADGRG2;
  Gene Name: adhesion G prt-coupled receptor G2;
  Uniprot ID:  Q8IZP9;
  ENSP ID: ENSP00000369198
MVFSVRQCGHVGRTEEVLLTFKIFLVIICLHVVLVTSLEEDTDNSSLSPPPAKLSVVSFAPSSNGTPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 3077 - protein, 966 aa, Homo sapiens
  Payload ID: 689;
  Gene Symbol: ADGRG2;
  Gene Name: adhesion G prt-coupled receptor G2;
  Uniprot ID:  Q8IZP9;
  ENSP ID: ENSP00000369202
MVFSVRQCGHVGRTEEVLLTFKIFLVIICLHVVLVTSLEEDTDNSSLSPPPAKLSVVSFAPSSNGTPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSGNASTERNGVSFSVQNGDVCLHDFTGKQHMFNEKEDSCNGKGRMALRRTSKRGSLHFIEQM

SEQ ID NO: 3078 - protein, 993 aa, Homo sapiens
  Payload ID: 689;
  Gene Symbol: ADGRG2;
  Gene Name: adhesion G prt-coupled receptor G2;
  Uniprot ID:  Q8IZP9;
  ENSP ID: ENSP00000369205
MVFSVRQCGHVGRTEEVLLTFKIFLVIICLHVVLVTSLEEDTDNSSLSPPPDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 3079 - protein, 1001 aa, Homo sapiens
  Payload ID: 689;
  Gene Symbol: ADGRG2;
  Gene Name: adhesion G prt-coupled receptor G2;
  Uniprot ID:  Q8IZP9;
  ENSP ID: ENSP00000369207
MVFSVRQCGHVGRTEEVLLTFKIFLVIICLHVVLVTSLEEDTDNSSLSPPPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 3080 - protein, 549 aa, Homo sapiens
  Payload ID: 690;
  Gene Symbol: ADGRG3;
  Gene Name: adhesion G prt-coupled receptor G3;
  Uniprot ID:  Q86Y34;
  ENSP ID: ENSP00000332900
MATPRGLGALLLLLLLPTSGQEKPTEGPRNTCLGSNNMYDIFNLNDKALCFTKCRQSGSDSCNVENLQRYWLNYEAHLMKEGLTQKVNTPFLKALVQNLSTNTAEDFYFSLEPSQVPRQVMKDEDKPPDRVRLPKSLFRSLPGNRSVVRLAVTILDIGPGTLFKGPRLGLGDGSGVLNNRLVGLSVGQMHVTKLAEPLEIVFSHQRPPPNMTLTCVFWDVTKGTTGDWSSEGCSTEVRPEGTVCCCDHLTFFALLLRPTLDQSTVHILTRISQAGCGVSMIFLAFTIILYAFLRLSRERFKSEDAPKIHVALGGSLFLLNLAFLVNVGSGSKGSDAACWARGAVFHYFLLCAFTWMGLEAFHLYLLAVRVFNTYFGHYFLKLSLVGWGLPALMVIGTGSANSYGLYTIRDRENRTSLELCWFREGTTMYALYITVHGYFLITFLFGMVVLALVVWKIFTLSRATAVKERGKNRKKVLTLLGLSSLVGVTWGLAIFTPLGLSTVYIFALFNSLQGVFICCWFTILYLPSQSTTVSSSTARLDQAHSASQE

SEQ ID NO: 3081 - protein, 429 aa, Homo sapiens
  Payload ID: 690;
  Gene Symbol: ADGRG3;
  Gene Name: adhesion G prt-coupled receptor G3;
  ENSP ID: ENSP00000404803
MKDEDKPPDRVRLPKSLFRSLPGNRSVVRLAVTILDIGPGTLFKGPRLGLGDGSGVLNNRLVGLSVGQMHVTKLAEPLEIVFSHQRPPPNMTLTCVFWDVTKGTTGDWSSEGCSTEVRPEGTVCCCDHLTFFALLLRPTLDQSTVHILTRISQAGCGVSMIFLAFTIILYAFLRLSRERFKSEDAPKIHVALGGSLFLLNLAFLVNVGSGSKGSDAACWARGAVFHYFLLCAFTWMGLEAFHLYLLAVRVFNTYFGHYFLKLSLVGWGLPALMVIGTGSANSYGLYTIRDRENRTSLELCWFREGTTMYALYITVHGYFLITFLFGMVVLALVVWKIFTLSRATAVKERGKNRKKVLTLLGLSSLVGVTWGLAIFTPLGLSTVYIFALFNSLQGVFICCWFTILYLPSQSTTVSSSTARLDQAHSASQE

SEQ ID NO: 3082 - protein, 315 aa, Homo sapiens
  Payload ID: 690;
  Gene Symbol: ADGRG3;
  Gene Name: adhesion G prt-coupled receptor G3;
  ENSP ID: ENSP00000456409
MATPRGLGALLLLLLLPTSGQEKPTEGPRNTCLGSNNMYDIFNLNDKALCFTKCRQSGSDSCNVENLQRYWLNYEAHLMKEGLTQKVNTPFLKALVQNLSTNTAEDFYFSLEPSQVPRQVMKDEDKPPDRVRLPKSLFRSLPGNRSVVRLAVTILDIGPGTLFKGPRLGLGDGSGVLNNRLVGLSVGQMHVTKLAEPLEIVFSHQRPPPNMTLTCVFWDVTKGTTGDWSSEGCSTEVRPEGTVCCCDHLTFFALLLRPTLDQSTVHILTRISQAGCGVSMIFLAFTIILYAFLRPARPDGHRHWECQQLRPLHHP

SEQ ID NO: 3083 - protein, 69 aa, Homo sapiens
  Payload ID: 690;
  Gene Symbol: ADGRG3;
  Gene Name: adhesion G prt-coupled receptor G3;
  ENSP ID: ENSP00000456576
MATPRGLGALLLLLLLPTSGQEKPTEGPRNTCLGSNNMYDIFNLNDKALCFTKCRQSGSDSCNVENLQR

SEQ ID NO: 3084 - protein, 3080 aa, Homo sapiens
  Payload ID: 691;
  Gene Symbol: ADGRG4;
  Gene Name: adhesion G prt-coupled receptor G4;
  Uniprot ID:  Q8IZF6;
  ENSP ID: ENSP00000359686
MKEHIIYQKLYGLILMSSFIFLSDTLSLKGKKLDFFGRGDTYVSLIDTIPELSRFTACIDLVFMDDNSRYWMAFSYITNNALLGREDIDLGLAGDHQQLILYRLGKTFSIRHHLASFQWHTICLIWDGVKGKLELFLNKERILEVTDQPHNLTPHGTLFLGHFLKNESSEVKSMMRSFPGSLYYFQLWDHILENEEFMKCLDGNIVSWEEDVWLVNKIIPTVDRTLRCFVPENMTIQEKSTTVSQQIDMTTPSQITGVKPQNTAHSSTLLSQSIPIFATDYTTISYSNTTSPPLETMTAQKILKTLVDETATFAVDVLSTSSAISLPTQSISIDNTTNSMKKTKSPSSESTKTTKMVEAMATEIFQPPTPSNFLSTSRFTKNSVVSTTSAIKSQSAVTKTTSLFSTIESTSMSTTPCLKQKSTNTGALPISTAGQEFIESTAAGTVPWFTVEKTSPASTHVGTASSFPPEPVLISTAAPVDSVFPRNQTAFPLATTDMKIAFTVHSLTLPTRLIETTPAPRTAETELTSTNFQDVSLPRVEDAMSTSMSKETSSKTFSFLTSFSFTGTESVQTVIDAEATRTALTPEITLASTVAETMLSSTITGRVYTQNTPTADGHLLTLMSTRSASTSKAPESGPTSTTDEAAHLFSSNETIWTSRPDQALLASMNTTTILTFVPNENFTSAFHENTTYTEYLSATTNITPLKASPEGKGTTANDATTARYTTAVSKLTSPWFANFSIVSGTTSITNMPEFKLTTLLLKTIPMSTKPANELPLTPRETVVPSVDIISTLACIQPNFSTEESASETTQTEINGAIVFGGTTTPVPKSATTQRLNATVTRKEATSHYLMRKSTIAAVAEVSPFSTMLEVTDESAQRVTASVTVSSFPDIEKLSTPLDNKTATTEVRESWLLTKLVKTTPRSSYNEMTEMFNFNHTYVAHWTSETSEGISAGSPTSGSTHIFGEPLGASTTRISETSFSTTPTDRTATSLSDGILPPQPTAAHSSATPVPVTHMFSLPVNGSSVVAEETEVTMSEPSTLARAFSTSVLSDVSNLSSTTMTTALVPPLDQTASTTIVIVPTHGDLIRTTSEATVISVRKTSMAVPSLTETPFHSLRLSTPVTAKAETTLFSTSVDTVTPSTHTLVCSKPPPDNIPPASSTHVISTTSTPEATQPISQVEETSTYALSFPYTFSGGGVVASLATGTTETSVVDETTPSHISANKLTTSVNSHISSSATYRVHTPVSIQLVTSTSVLSSDKDQMTISLGKTPRTMEVTEMSPSKNSFISYSRGTPSLEMTDTGFPETTKISSHQTHSPSEIPLGTPSDGNLASSPTSGSTQITPTLTSSNTVGVHIPEMSTSLGKTALPSQALTITTFLCPEKESTSALPAYTPRTVEMIVNSTYVTHSVSYGQDTSFVDTTTSSSTRISNPMDINTTFSHLHSLRTQPEVTSVASFISESTQTFPESLSLSTAGLYNDGFTVLSDRITTAFSVPNVPTMLPRESSMATSTPIYQMSSLPVNVTAFTSKKVSDTPPIVITKSSKTMHPGCLKSPCTATSGPMSEMSSIPVNNSAFTPATVSSDTSTRVGLFSTLLSSVTPRTTMTMQTSTLDVTPVIYAGATSKNKMVSSAFTTEMIEAPSRITPTTFLSPTEPTLPFVKTVPTTIMAGIVTPFVGTTAFSPLSSKSTGAISSIPKTTFSPFLSATQQSSQADEATTLGILSGITNRSLSTVNSGTGVALTDTYSRITVPENMLSPTHADSLHTSFNIQVSPSLTSFKSASGPTKNVKTTTNCFSSNTRKMTSLLEKTSLTNYATSLNTPVSYPPWTPSSATLPSLTSFVYSPHSTEAEISTPKTSPPPTSQMVEFPVLGTRMTSSNTQPLLMTSWNIPTAEGSQFPISTTINVPTSNEMETETLHLVPGPLSTFTASQTGLVSKDVMAMSSIPMSGILPNHGLSENPSLSTSLRAITSTLADVKHTFEKMTTSVTPGTTLPSILSGATSGSVISKSPILTWLLSSLPSGSPPATVSNAPHVMTSSTVEVSKSTFLTSDMISAHPFTNLTTLPSATMSTILTRTIPTPTLGGITTGFPTSLPMSINVTDDIVYISTHPEASSRTTITANPRTVSHPSSFSRKTMSPSTTDHTLSVGAMPLPSSTITSSWNRIPTASSPSTLIIPKPTLDSLLNIMTTTSTVPGASFPLISTGVTYPFTATVSSPISSFFETTWLDSTPSFLSTEASTSPTATKSTVSFYNVEMSFSVFVEEPRIPITSVINEFTENSLNSIFQNSEFSLATLETQIKSRDISEEEMVMDRAILEQREGQEMATISYVPYSCVCQVIIKASSSLASSELMRKIKSKIHGNFTHGNFTQDQLTLLVNCEHVAVKKLEPGNCKADETASKYKGTYKWLLTNPTETAQTRCIKNEDGNATRFCSISINTGKSQWEKPKFKQCKLLQELPDKIVDLANITISDENAEDVAEHILNLINESPALGKEETKIIVSKISDISQCDEISMNLTHVMLQIINVVLEKQNNSASDLHEISNEILRIIERTGHKMEFSGQIANLTVAGLALAVLRGDHTFDGMAFSIHSYEEGTDPEIFLGNVPVGGILASIYLPKSLTERIPLSNLQTILFNFFGQTSLFKTKNVTKALTTYVVSASISDDMFIQNLADPVVITLQHIGGNQNYGQVHCAFWDFENNNGLGGWNSSGCKVKETNVNYTICQCDHLTHFGVLMDLSRSTVDSVNEQILALITYTGCGISSIFLGVAVVTYIAFHKLRKDYPAKILINLCTALLMLNLVFLINSWLSSFQKVGVCITAAVALHYFLLVSFTWMGLEAVHMYLALVKVFNIYIPNYILKFCLVGWGIPAIMVAITVSVKKDLYGTLSPTTPFCWIKDDSIFYISVVAYFCLIFLMNLSMFCTVLVQLNSVKSQIQKTRRKMILHDLKGTMSLTFLLGLTWGFAFFAWGPMRNFFLYLFAIFNTLQGFFIFVFHCVMKESVREQWQIHLCCGWLRLDNSSDGSSRCQIKVGYKQEGLKKIFEHKLLTPSLKSTATSSTFKSLGSAQGTPSEISFPNDDFDKDPYCSSP

SEQ ID NO: 3085 - protein, 2875 aa, Homo sapiens
  Payload ID: 691;
  Gene Symbol: ADGRG4;
  Gene Name: adhesion G prt-coupled receptor G4;
  Uniprot ID:  Q8IZF6;
  ENSP ID: ENSP00000377697
MKEHIIYQKLYGLILMSSFIFLSVVPENMTIQEKSTTVSQQIDMTTPSQITGVKPQNTAHSSTLLSQSIPIFATDYTTISYSNTTSPPLETMTAQKILKTLVDETATFAVDVLSTSSAISLPTQSISIDNTTNSMKKTKSPSSESTKTTKMVEAMATEIFQPPTPSNFLSTSRFTKNSVVSTTSAIKSQSAVTKTTSLFSTIESTSMSTTPCLKQKSTNTGALPISTAGQEFIESTAAGTVPWFTVEKTSPASTHVGTASSFPPEPVLISTAAPVDSVFPRNQTAFPLATTDMKIAFTVHSLTLPTRLIETTPAPRTAETELTSTNFQDVSLPRVEDAMSTSMSKETSSKTFSFLTSFSFTGTESVQTVIDAEATRTALTPEITLASTVAETMLSSTITGRVYTQNTPTADGHLLTLMSTRSASTSKAPESGPTSTTDEAAHLFSSNETIWTSRPDQALLASMNTTTILTFVPNENFTSAFHENTTYTEYLSATTNITPLKASPEGKGTTANDATTARYTTAVSKLTSPWFANFSIVSGTTSITNMPEFKLTTLLLKTIPMSTKPANELPLTPRETVVPSVDIISTLACIQPNFSTEESASETTQTEINGAIVFGGTTTPVPKSATTQRLNATVTRKEATSHYLMRKSTIAAVAEVSPFSTMLEVTDESAQRVTASVTVSSFPDIEKLSTPLDNKTATTEVRESWLLTKLVKTTPRSSYNEMTEMFNFNHTYVAHWTSETSEGISAGSPTSGSTHIFGEPLGASTTRISETSFSTTPTDRTATSLSDGILPPQPTAAHSSATPVPVTHMFSLPVNGSSVVAEETEVTMSEPSTLARAFSTSVLSDVSNLSSTTMTTALVPPLDQTASTTIVIVPTHGDLIRTTSEATVISVRKTSMAVPSLTETPFHSLRLSTPVTAKAETTLFSTSVDTVTPSTHTLVCSKPPPDNIPPASSTHVISTTSTPEATQPISQVEETSTYALSFPYTFSGGGVVASLATGTTETSVVDETTPSHISANKLTTSVNSHISSSATYRVHTPVSIQLVTSTSVLSSDKDQMTISLGKTPRTMEVTEMSPSKNSFISYSRGTPSLEMTDTGFPETTKISSHQTHSPSEIPLGTPSDGNLASSPTSGSTQITPTLTSSNTVGVHIPEMSTSLGKTALPSQALTITTFLCPEKESTSALPAYTPRTVEMIVNSTYVTHSVSYGQDTSFVDTTTSSSTRISNPMDINTTFSHLHSLRTQPEVTSVASFISESTQTFPESLSLSTAGLYNDGFTVLSDRITTAFSVPNVPTMLPRESSMATSTPIYQMSSLPVNVTAFTSKKVSDTPPIVITKSSKTMHPGCLKSPCTATSGPMSEMSSIPVNNSAFTPATVSSDTSTRVGLFSTLLSSVTPRTTMTMQTSTLDVTPVIYAGATSKNKMVSSAFTTEMIEAPSRITPTTFLSPTEPTLPFVKTVPTTIMAGIVTPFVGTTAFSPLSSKSTGAISSIPKTTFSPFLSATQQSSQADEATTLGILSGITNRSLSTVNSGTGVALTDTYSRITVPENMLSPTHADSLHTSFNIQVSPSLTSFKSASGPTKNVKTTTNCFSSNTRKMTSLLEKTSLTNYATSLNTPVSYPPWTPSSATLPSLTSFVYSPHSTEAEISTPKTSPPPTSQMVEFPVLGTRMTSSNTQPLLMTSWNIPTAEGSQFPISTTINVPTSNEMETETLHLVPGPLSTFTASQTGLVSKDVMAMSSIPMSGILPNHGLSENPSLSTSLRAITSTLADVKHTFEKMTTSVTPGTTLPSILSGATSGSVISKSPILTWLLSSLPSGSPPATVSNAPHVMTSSTVEVSKSTFLTSDMISAHPFTNLTTLPSATMSTILTRTIPTPTLGGITTGFPTSLPMSINVTDDIVYISTHPEASSRTTITANPRTVSHPSSFSRKTMSPSTTDHTLSVGAMPLPSSTITSSWNRIPTASSPSTLIIPKPTLDSLLNIMTTTSTVPGASFPLISTGVTYPFTATVSSPISSFFETTWLDSTPSFLSTEASTSPTATKSTVSFYNVEMSFSVFVEEPRIPITSVINEFTENSLNSIFQNSEFSLATLETQIKSRDISEEEMVMDRAILEQREGQEMATISYVPYSCVCQVIIKASSSLASSELMRKIKSKIHGNFTHGNFTQDQLTLLVNCEHVAVKKLEPGNCKADETASKYKGTYKWLLTNPTETAQTRCIKNEDGNATRFCSISINTGKSQWEKPKFKQCKLLQELPDKIVDLANITISDENAEDVAEHILNLINESPALGKEETKIIVSKISDISQCDEISMNLTHVMLQIINVVLEKQNNSASDLHEISNEILRIIERTGHKMEFSGQIANLTVAGLALAVLRGDHTFDGMAFSIHSYEEGTDPEIFLGNVPVGGILASIYLPKSLTERIPLSNLQTILFNFFGQTSLFKTKNVTKALTTYVVSASISDDMFIQNLADPVVITLQHIGGNQNYGQVHCAFWDFENNNGLGGWNSSGCKVKETNVNYTICQCDHLTHFGVLMDLSRSTVDSVNEQILALITYTGCGISSIFLGVAVVTYIAFHKLRKDYPAKILINLCTALLMLNLVFLINSWLSSFQKVGVCITAAVALHYFLLVSFTWMGLEAVHMYLALVKVFNIYIPNYILKFCLVGWGIPAIMVAITVSVKKDLYGTLSPTTPFCWIKDDSIFYISVVAYFCLIFLMNLSMFCTVLVQLNSVKSQIQKTRRKMILHDLKGTMSLTFLLGLTWGFAFFAWGPMRNFFLYLFAIFNTLQGFFIFVFHCVMKESVREQWQIHLCCGWLRLDNSSDGSSRCQIKVGYKQEGLKKIFEHKLLTPSLKSTATSSTFKSLGSAQGTPSEISFPNDDFDKDPYCSSP

SEQ ID NO: 3086 - protein, 3080 aa, Homo sapiens; identical to SEQ ID NO: 3084
  Payload ID: 691;
  Gene Symbol: ADGRG4;
  Gene Name: adhesion G prt-coupled receptor G4;
  Uniprot ID:  Q8IZF6;
  ENSP ID: ENSP00000377699

SEQ ID NO: 3087 - protein, 528 aa, Homo sapiens
  Payload ID: 692;
  Gene Symbol: ADGRG5;
  Gene Name: adhesion G prt-coupled receptor G5;
  Uniprot ID:  Q8IZF4;
  ENSP ID: ENSP00000290823
MDHCGALFLCLCLLTLQNATTETWEELLSYMENMQVSRGRSSVFSSRQLHQLEQMLLNTSFPGYNLTLQTPTIQSLAFKLSCDFSGLSLTSATLKRVPQAGGQHARGQHAMQFPAELTRDACKTRPRELRLICIYFSNTHFFKDENNSSLLNNYVLGAQLSHGHVNNLRDPVNISFWHNQSLEGYTLTCVFWKEGARKQPWGGWSPEGCRTEQPSHSQVLCRCNHLTYFAVLMQLSPALVPAELLAPLTYISLVGCSISIVASLITVLLHFHFRKQSDSLTRIHMNLHASVLLLNIAFLLSPAFAMSPVPGSACTALAAALHYALLSCLTWMAIEGFNLYLLLGRVYNIYIRRYVFKLGVLGWGAPALLVLLSLSVKSSVYGPCTIPVFDSWENGTGFQNMSICWVRSPVVHSVLVMGYGGLTSLFNLVVLAWALWTLRRLRERADAPSVRACHDTVTVLGLTVLLGTTWALAFFSFGVFLLPQLFLFTILNSLYGFFLFLWFCSQRCRSEAEAKAQIEAFSSSQTTQ

SEQ ID NO: 3088 - protein, 528 aa, Homo sapiens; identical to SEQ ID NO: 3087
  Payload ID: 692;
  Gene Symbol: ADGRG5;
  Gene Name: adhesion G prt-coupled receptor G5;
  Uniprot ID:  Q8IZF4;
  ENSP ID: ENSP00000342981

SEQ ID NO: 3089 - protein, 221 aa, Homo sapiens
  Payload ID: 692;
  Gene Symbol: ADGRG5;
  Gene Name: adhesion G prt-coupled receptor G5;
  ENSP ID: ENSP00000482481
MDHCGALFLCLCLLTLQNATTETWEELLSYMENMQVSRGRSSVFSSRQLHQLEQMLLNTSFPGYNLTLQTPTIQSLAFKLSCDFSGLSLTSATLKRVPQAGGQHARGQHAMQFPAELTRDACKTRPRELRLICIYFSNTHFFKDENNSSLLNNYVLGAQLSHGHVNNLRDPVNISFWHNQSLVLLGAPPFPLHPCPSVTLLLNTGLTRPKPVEPSWKSITL

SEQ ID NO: 3090 - protein, 1221 aa, Homo sapiens
  Payload ID: 693;
  Gene Symbol: ADGRG6;
  Gene Name: adhesion G prt-coupled receptor G6;
  Uniprot ID:  Q86SQ4;
  ENSP ID: ENSP00000230173
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQATVNSPSTTPPTVTTNMPVTNRIDKQRNDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRQHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 3091 - protein, 1193 aa, Homo sapiens
  Payload ID: 693;
  Gene Symbol: ADGRG6;
  Gene Name: adhesion G prt-coupled receptor G6;
  Uniprot ID:  Q86SQ4;
  ENSP ID: ENSP00000296932
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRQHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 3092 - protein, 1222 aa, Homo sapiens
  Payload ID: 693;
  Gene Symbol: ADGRG6;
  Gene Name: adhesion G prt-coupled receptor G6;
  Uniprot ID:  Q86SQ4;
  ENSP ID: ENSP00000356580
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRQHLCCGRFRLADNSDWSKTATNIIKKSSDNLGKSLSSSSIGSNSTYLTSKSKSSSTTYFKRNSHTDSASMDKSLSKLAHADGDQTSIIPVHQVIDKVKGYCNAHSDNFYKNIIMSDTFSHSTKF

SEQ ID NO: 3093 - protein, 1250 aa, Homo sapiens
  Payload ID: 693;
  Gene Symbol: ADGRG6;
  Gene Name: adhesion G prt-coupled receptor G6;
  Uniprot ID:  Q86SQ4;
  ENSP ID: ENSP00000356581
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQATVNSPSTTPPTVTTNMPVTNRIDKQRNDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRQHLCCGRFRLADNSDWSKTATNIIKKSSDNLGKSLSSSSIGSNSTYLTSKSKSSSTTYFKRNSHTDSASMDKSLSKLAHADGDQTSIIPVHQVIDKVKGYCNAHSDNFYKNIIMSDTFSHSTKF

SEQ ID NO: 3094 - protein, 141 aa, Homo sapiens
  Payload ID: 693;
  Gene Symbol: ADGRG6;
  Gene Name: adhesion G prt-coupled receptor G6;
  ENSP ID: ENSP00000438366
MFRSDRMWSCHWKWKPSPLLFLFALYIMCVPHSAVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKG

SEQ ID NO: 3095 - protein, 103 aa, Homo sapiens
  Payload ID: 693;
  Gene Symbol: ADGRG6;
  Gene Name: adhesion G prt-coupled receptor G6;
  ENSP ID: ENSP00000439371
  MOD_RES (1)..(1): Any amino acid
XLGSTLMNIFSNILSSSDSDLLESSSEALKTIDELAFKIDLNSTSHVNITTRNLALSVSSLLPGTNAISNFSIGLPSNNESYFQLLSFTTCFEKTSKSAADGF

SEQ ID NO: 3096 - protein, 135 aa, Homo sapiens
  Payload ID: 693;
  Gene Symbol: ADGRG6;
  Gene Name: adhesion G prt-coupled receptor G6;
  ENSP ID: ENSP00000444123
  MOD_RES (1)..(1): Any amino acid
XVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRIW

SEQ ID NO: 3097 - protein, 241 aa, Homo sapiens
  Payload ID: 693;
  Gene Symbol: ADGRG6;
  Gene Name: adhesion G prt-coupled receptor G6;
  ENSP ID: ENSP00000446287
MFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEK

SEQ ID NO: 3098 - protein, 797 aa, Homo sapiens
  Payload ID: 694;
  Gene Symbol: ADGRG7;
  Gene Name: adhesion G prt-coupled receptor G7;
  Uniprot ID:  Q96K78;
  ENSP ID: ENSP00000273352
MASCRAWNLRVLVAVVCGLLTGIILGLGIWRIVIRIQRGKSTSSSSTPTEFCRNGGTWENGRCICTEEWKGLRCTIANFCENSTYMGFTFARIPVGRYGPSLQTCGKDTPNAGNPMAVRLCSLSLYGEIELQKVTIGNCNENLETLEKQVKDVTAPLNNISSEVQILTSDANKLTAENITSATRVVGQIFNTSRNASPEAKKVAIVTVSQLLDASEDAFQRVAATANDDALTTLIEQMETYSLSLGNQSVVEPNIAIQSANFSSENAVGPSNVRFSVQKGASSSLVSSSTFIHTNVDGLNPDAQTELQVLLNMTKNYTKTCGFVVYQNDKLFQSKTFTAKSDFSQKIISSKTDENEQDQSASVDMVFSPKYNQKEFQLYSYACVYWNLSAKDWDTYGCQKDKGTDGFLRCRCNHTTNFAVLMTFKKDYQYPKSLDILSNVGCALSVTGLALTVIFQIVTRKVRKTSVTWVLVNLCISMLIFNLLFVFGIENSNKNLQTSDGDINNIDFDNNDIPRTDTINIPNPMCTAIAALLHYFLLVTFTWNALSAAQLYYLLIRTMKPLPRHFILFISLIGWGVPAIVVAITVGVIYSQNGNNPQWELDYRQEKICWLAIPEPNGVIKSPLLWSFIVPVTIILISNVVMFITISIKVLWKNNQNLTSTKKVSSMKKIVSTLSVAVVFGITWILAYLMLVNDDSIRIVFSYIFCLFNTTQGLQIFILYTVRTKVFQSEASKVLMLLSSIGRRKSLPSVTRPRLRVKMYNFLRSLPTLHERFRLLETSPSTEEITLSESDNAKESI

SEQ ID NO: 3099 - protein, 502 aa, Homo sapiens
  Payload ID: 694;
  Gene Symbol: ADGRG7;
  Gene Name: adhesion G prt-coupled receptor G7;
  ENSP ID: ENSP00000419788
MPVKMLFKELLLLLMMMPLQHYTKTCGFVVYQNDKLFQSKTFTAKSDFSQKIISSKTDENEQDQSASVDMVFSPKYNQKEFQLYSYACVYWNLSAKDWDTYGCQKDKGTDGFLRCRCNHTTNFAVLMTFKKDYQYPKSLDILSNVGCALSVTGLALTVIFQIVTRKVRKTSVTWVLVNLCISMLIFNLLFVFGIENSNKNLQTSDGDINNIDFDNNDIPRTDTINIPNPMCTAIAALLHYFLLVTFTWNALSAAQLYYLLIRTMKPLPRHFILFISLIGWGVPAIVVAITVGVIYSQNGNNPQWELDYRQEKICWLAIPEPNGVIKSPLLWSFIVPVTIILISNVVMFITISIKVLWKNNQNLTSTKKVSSMKKIVSTLSVAVVFGITWILAYLMLVNDDSIRIVFSYIFCLFNTTQGLQIFILYTVRTKVFQSEASKVLMLLSSIGRRKSLPSVTRPRLRVKMYNFLRSLPTLHERFRLLETSPSTEEITLSESDNAKESI

SEQ ID NO: 3100 - protein, 1474 aa, Homo sapiens
  Payload ID: 695;
  Gene Symbol: ADGRL1;
  Gene Name: adhesion G prt-coupled receptor L1;
  Uniprot ID:  O94910;
  ENSP ID: ENSP00000340688
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 3101 - protein, 1469 aa, Homo sapiens
  Payload ID: 695;
  Gene Symbol: ADGRL1;
  Gene Name: adhesion G prt-coupled receptor L1;
  Uniprot ID:  O94910;
  ENSP ID: ENSP00000355328
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYIFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 3102 - protein, 264 aa, Homo sapiens
  Payload ID: 695;
  Gene Symbol: ADGRL1;
  Gene Name: adhesion G prt-coupled receptor L1;
  ENSP ID: ENSP00000465453
  MOD_RES (1)..(1): Any amino acid
XGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPELEPGLAFRAHPCLFSSLFWLPPAGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESES

SEQ ID NO: 3103 - protein, 243 aa, Homo sapiens
  Payload ID: 695;
  Gene Symbol: ADGRL1;
  Gene Name: adhesion G prt-coupled receptor L1;
  ENSP ID: ENSP00000468197
  MOD_RES (1)..(1): Any amino acid
XSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPEHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLS

SEQ ID NO: 3104 - protein, 225 aa, Homo sapiens
  Payload ID: 695;
  Gene Symbol: ADGRL1;
  Gene Name: adhesion G prt-coupled receptor L1;
  ENSP ID: ENSP00000468711
SAGHPSPRTQWVPSTSWDLICLQPQPQSPAPGGPQPRIYTCPLSSSASPERYGGSSGRPPSRACWWRGPAPRGLEIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQ

SEQ ID NO: 3105 - protein, 1403 aa, Homo sapiens
  Payload ID: 696;
  Gene Symbol: ADGRL2;
  Gene Name: adhesion G prt-coupled receptor L2;
  Uniprot ID:  O95490;
  ENSP ID: ENSP00000322270
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 3106 - protein, 1403 aa, Homo sapiens; identical to SEQ ID NO: 3105
  Payload ID: 696;
  Gene Symbol: ADGRL2;
  Gene Name: adhesion G prt-coupled receptor L2;
  Uniprot ID:  O95490;
  ENSP ID: ENSP00000353006

SEQ ID NO: 3107 - protein, 1123 aa, Homo sapiens
  Payload ID: 696;
  Gene Symbol: ADGRL2;
  Gene Name: adhesion G prt-coupled receptor L2;
  Uniprot ID:  O95490;
  ENSP ID: ENSP00000359748
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQDIH

SEQ ID NO: 3108 - protein, 1177 aa, Homo sapiens
  Payload ID: 696;
  Gene Symbol: ADGRL2;
  Gene Name: adhesion G prt-coupled receptor L2;
  Uniprot ID:  O95490;
  ENSP ID: ENSP00000359750
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGLTSHGLRAHLQDLYHLELLLGQIA

SEQ ID NO: 3109 - protein, 1459 aa, Homo sapiens
  Payload ID: 696;
  Gene Symbol: ADGRL2;
  Gene Name: adhesion G prt-coupled receptor L2;
  Uniprot ID:  O95490;
  ENSP ID: ENSP00000359752
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 3110 - protein, 1384 aa, Homo sapiens
  Payload ID: 696;
  Gene Symbol: ADGRL2;
  Gene Name: adhesion G prt-coupled receptor L2;
  ENSP ID: ENSP00000359756
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYMEQKVFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 3111 - protein, 1461 aa, Homo sapiens
  Payload ID: 696;
  Gene Symbol: ADGRL2;
  Gene Name: adhesion G prt-coupled receptor L2;
  Uniprot ID:  O95490;
  ENSP ID: ENSP00000359758
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 3112 - protein, 1474 aa, Homo sapiens
  Payload ID: 696;
  Gene Symbol: ADGRL2;
  Gene Name: adhesion G prt-coupled receptor L2;
  Uniprot ID:  O95490;
  ENSP ID: ENSP00000359760
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 3113 - protein, 1431 aa, Homo sapiens
  Payload ID: 696;
  Gene Symbol: ADGRL2;
  Gene Name: adhesion G prt-coupled receptor L2;
  ENSP ID: ENSP00000359762
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 3114 - protein, 1459 aa, Homo sapiens; identical to SEQ ID NO: 3109
  Payload ID: 696;
  Gene Symbol: ADGRL2;
  Gene Name: adhesion G prt-coupled receptor L2;
  Uniprot ID:  O95490;
  ENSP ID: ENSP00000359763

SEQ ID NO: 3115 - protein, 1416 aa, Homo sapiens
  Payload ID: 696;
  Gene Symbol: ADGRL2;
  Gene Name: adhesion G prt-coupled receptor L2;
  Uniprot ID:  O95490;
  ENSP ID: ENSP00000359765
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 3116 - protein, 471 aa, Homo sapiens
  Payload ID: 696;
  Gene Symbol: ADGRL2;
  Gene Name: adhesion G prt-coupled receptor L2;
  ENSP ID: ENSP00000385853
  MOD_RES (1)..(1): Any amino acid
XITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPATYRETRHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 3117 - protein, 1351 aa, Homo sapiens
  Payload ID: 696;
  Gene Symbol: ADGRL2;
  Gene Name: adhesion G prt-coupled receptor L2;
  ENSP ID: ENSP00000397740
  MOD_RES (1)..(1): Any amino acid
XFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGYEDNKPFIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 3118 - protein, 1431 aa, Homo sapiens; identical to SEQ ID NO: 3113
  Payload ID: 696;
  Gene Symbol: ADGRL2;
  Gene Name: adhesion G prt-coupled receptor L2;
  ENSP ID: ENSP00000485786

SEQ ID NO: 3119 - protein, 1580 aa, Homo sapiens
  Payload ID: 697;
  Gene Symbol: ADGRL3;
  Gene Name: adhesion G prt-coupled receptor L3;
  ENSP ID: ENSP00000420931
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 3120 - protein, 1528 aa, Homo sapiens
  Payload ID: 697;
  Gene Symbol: ADGRL3;
  Gene Name: adhesion G prt-coupled receptor L3;
  ENSP ID: ENSP00000421372
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 3121 - protein, 1342 aa, Homo sapiens
  Payload ID: 697;
  Gene Symbol: ADGRL3;
  Gene Name: adhesion G prt-coupled receptor L3;
  ENSP ID: ENSP00000421476
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEPYRETSMGVKLNIAYQIGASEQCQGYKCHGYSTTEW

SEQ ID NO: 3122 - protein, 1512 aa, Homo sapiens
  Payload ID: 697;
  Gene Symbol: ADGRL3;
  Gene Name: adhesion G prt-coupled receptor L3;
  ENSP ID: ENSP00000421627
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 3123 - protein, 1469 aa, Homo sapiens
  Payload ID: 697;
  Gene Symbol: ADGRL3;
  Gene Name: adhesion G prt-coupled receptor L3;
  Uniprot ID:  Q9HAR2;
  ENSP ID: ENSP00000422533
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 3124 - protein, 1240 aa, Homo sapiens
  Payload ID: 697;
  Gene Symbol: ADGRL3;
  Gene Name: adhesion G prt-coupled receptor L3;
  Uniprot ID:  Q9HAR2;
  ENSP ID: ENSP00000423388
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 3125 - protein, 1283 aa, Homo sapiens
  Payload ID: 697;
  Gene Symbol: ADGRL3;
  Gene Name: adhesion G prt-coupled receptor L3;
  ENSP ID: ENSP00000423434
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEPYRETSMGVKLNIAYQIGASEQCQGYKCHGYSTTEW

SEQ ID NO: 3126 - protein, 1308 aa, Homo sapiens
  Payload ID: 697;
  Gene Symbol: ADGRL3;
  Gene Name: adhesion G prt-coupled receptor L3;
  ENSP ID: ENSP00000423787
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 3127 - protein, 1351 aa, Homo sapiens
  Payload ID: 697;
  Gene Symbol: ADGRL3;
  Gene Name: adhesion G prt-coupled receptor L3;
  ENSP ID: ENSP00000424030
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEPYRETSMGVKLNIAYQIGASEQCQGYKCHGYSTTEW

SEQ ID NO: 3128 - protein, 1231 aa, Homo sapiens
  Payload ID: 697;
  Gene Symbol: ADGRL3;
  Gene Name: adhesion G prt-coupled receptor L3;
  ENSP ID: ENSP00000424120
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 3129 - protein, 1503 aa, Homo sapiens
  Payload ID: 697;
  Gene Symbol: ADGRL3;
  Gene Name: adhesion G prt-coupled receptor L3;
  ENSP ID: ENSP00000424258
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 3130 - protein, 918 aa, Homo sapiens
  Payload ID: 697;
  Gene Symbol: ADGRL3;
  Gene Name: adhesion G prt-coupled receptor L3;
  ENSP ID: ENSP00000424402
  MOD_RES (1)..(1): Any amino acid
XYLCLAPDGIWDPQGPDLSNCSSPWVNHITQKLKSGETAANIARELAEQTRNHLNAGDITYSVRAMDQLVGLLDVQLRNLTPGGKDSAARSLNKAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 3131 - protein, 1299 aa, Homo sapiens
  Payload ID: 697;
  Gene Symbol: ADGRL3;
  Gene Name: adhesion G prt-coupled receptor L3;
  ENSP ID: ENSP00000425033
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 3132 - protein, 1274 aa, Homo sapiens
  Payload ID: 697;
  Gene Symbol: ADGRL3;
  Gene Name: adhesion G prt-coupled receptor L3;
  ENSP ID: ENSP00000425201
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEPYRETSMGVKLNIAYQIGASEQCQGYKCHGYSTTEW

SEQ ID NO: 3133 - protein, 1571 aa, Homo sapiens
  Payload ID: 697;
  Gene Symbol: ADGRL3;
  Gene Name: adhesion G prt-coupled receptor L3;
  ENSP ID: ENSP00000425884
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 3134 - protein, 1345 aa, Homo sapiens
  Payload ID: 697;
  Gene Symbol: ADGRL3;
  Gene Name: adhesion G prt-coupled receptor L3;
  ENSP ID: ENSP00000439831
PIEVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 3135 - protein, 690 aa, Homo sapiens
  Payload ID: 698;
  Gene Symbol: ADGRL4;
  Gene Name: adhesion G prt-coupled receptor L4;
  Uniprot ID:  Q9HBW9;
  ENSP ID: ENSP00000359778
MKRLPLLVVFSTLLNCSYTQNCTKTPCLPNAKCEIRNGIEACYCNMGFSGNGVTICEDDNECGNLTQSCGENANCTNTEGSYYCMCVPGFRSSSNQDRFITNDGTVCIENVNANCHLDNVCIAANINKTLTKIRSIKEPVALLQEVYRNSVTDLSPTDIITYIEILAESSSLLGYKNNTISAKDTLSNSTLTEFVKTVNNFVQRDTFVVWDKLSVNHRRTHLTKLMHTVEQATLRISQSFQKTTEFDTNSTDIALKVFFFDSYNMKHIHPHMNMDGDYINIFPKRKAAYDSNGNVAVAFVYYKSIGPLLSSSDNFLLKPQNYDNSEEEERVISSVISVSMSSNPPTLYELEKITFTLSHRKVTDRYRSLCAFWNYSPDTMNGSWSSEGCELTYSNETHTSCRCNHLTHFAILMSSGPSIGIKDYNILTRITQLGIIISLICLAICIFTFWFFSEIQSTRTTIHKNLCCSLFLAELVFLVGINTNTNKLFCSIIAGLLHYFFLAAFAWMCIEGIHLYLIVVGVIYNKGFLHKNFYIFGYLSPAVVVGFSAALGYRYYGTTKVCWLSTENNFIWSFIGPACLIILVNLLAFGVIIYKVFRHTAGLKPEVSCFENIRSCARGALALLFLLGTTWIFGVLHVVHASVVTAYLFTVSNAFQGMFIFLFLCVLSRKIQEEYYRLFKNVPCCFGCLR

SEQ ID NO: 3136 - protein, 149 aa, Homo sapiens
  Payload ID: 698;
  Gene Symbol: ADGRL4;
  Gene Name: adhesion G prt-coupled receptor L4;
  ENSP ID: ENSP00000383813
VVVGFSAALGYRYYGTTKVCWLSTENNFIWSFIGPACLIILVNLLAFGVIIYKVFRHTAGLKPEVSCFENIRSCARGALALLFLLGTTWIFGVLHVVHASVVTAYLFTVSNAFQGMFIFLFLCVLSRKIQEEYYRLFKNVPCCFGCLSC

SEQ ID NO: 3137 - protein, 6306 aa, Homo sapiens
  Payload ID: 699;
  Gene Symbol: ADGRV1;
  Gene Name: adhesion G prt-coupled receptor V1;
  Uniprot ID:  Q8WXG9;
  ENSP ID: ENSP00000384582
MSVFLGPGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPEPDETFIFHLTLQKPSANVKLGWPRTVTVTILSNDNAFGIISFNMLPSIAVSEPKGRNESMPLTLIREKGTYGMVMVTFEVEGGPNPPDEDLSPVKGNITFPPGRATVIYNLTVLDDEVPENDEIFLIQLKSVEGGAEINTSRNSIEIIIKKNDSPVRFLQSIYLVPEEDHILIIPVVRGKDNNGNLIGSDEYEVSISYAVTTGNSTAHAQQNLDFIDLQPNTTVVFPPFIHESHLKFQIVDDTIPEIAESFHIMLLKDTLQGDAVLISPSVVQVTIKPNDKPYGVLSFNSVLFERTVIIDEDRISRYEEITVVRNGGTHGNVSANWVLTRNSTDPSPVTADIRPSSGVLHFAQGQMLATIPLTVVDDDLPEEAEAYLLQILPHTIRGGAEVSEPAELLFYIQDSDDVYGLITFFPMENQKIESSPGERYLSLSFTRLGGTKGDVRLLYSVLYIPAGAVDPLQAKEGILNISRRNDLIFPEQKTQVTTKLPIRNDAFLQNGAHFLVQLETVELLNIIPLIPPISPRFGEICNISLLVTPAIANGEIGFLSNLPIILHEPEDFAAEVVYIPLHRDGTDGQATVYWSLKPSGFNSKAVTPDDIGPFNGSVLFLSGQSDTTINITIKGDDIPEMNETVTLSLDRVNVENQVLKSGYTSRDLIILENDDPGGVFEFSPASRGPYVIKEGESVELHIIRSRGSLVKQFLHYRVEPRDSNEFYGNTGVLEFKPGEREIVITLLARLDGIPELDEHYWVVLSSHGERESKLGSATIVNITILKNDDPHGIIEFVSDGLIVMINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSTGDTVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGGSPGPGGQLAETNLQVTVMVPFNDDPFGVFILDPECLEREVAEDVLSEDDMSYITNFTILRQQGVFGDVQLGWEILSSEFPAGLPPMIDFLLVGIFPTTVHLQQHMRRHHSGTDALYFTGLEGAFGTVNPKYHPSRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGPGILRIGAGINGNDRFTGLMQDVRSYERKLTLEEIYELHAMPAKSDLHPISGYLEFRQGETNKSFIISARDDNDEEGEELFILKLVSVYGGARISEENTTARLTIQKSDNANGLFGFTGACIPEIAEEGSTISCVVERTRGALDYVHVFYTISQIETDGINYLVDDFANASGTITFLPWQRSEVLNIYVLDDDIPELNEYFRVTLVSAIPGDGKLGSTPTSGASIDPEKETTDITIKASDHPYGLLQFSTGLPPQPKDAMTLPASSVPHITVEEEDGEIRLLVIRAQGLLGRVTAEFRTVSLTAFSPEDYQNVAGTLEFQPGERYKYIFINITDNSIPELEKSFKVELLNLEGGVAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGNVTFAPGETIQTLLLEVLADDVPEIEEVIQVQLTDASGGGTIGLDRIANIIIPANDDPYGTVAFAQMVYRVQEPLERSSCANITVRRSGGHFGRLLLFYSTSDIDVVALAMEEGQDLLSYYESPIQGVPDPLWRTWMNVSAVGEPLYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRLDSEGLTAQVIIDANDGARGVIEWQQSRFEVNETHGSLTLVAQRSREPLGHVSLFVYAQNLEAQVGLDYIFTPMILHFADGERYKNVNIMILDDDIPEGDEKFQLILTNPSPGLELGKNTIALIIVLANDDGPGVLSFNNSEHFFLREPTALYVQESVAVLYIVREPAQGLFGTVTVQFIVTEVNSSNESKDLTPSKGYIVLEEGVRFKALQISAILDTEPEMDEYFVCTLFNPTGGARLGVHVQTLITVLQNQAPLGLFSISAVENRATSIDIEEANRTVYLNVSRTNGIDLAVSVQWETVSETAFGMRGMDVVFSVFQSFLDESASGWCFFTLENLIYGIMLRKSSVTVYRWQGIFIPVEDLNIENPKTCEAFNIGFSPYFVITHEERNEEKPSLNSVFTFTSGFKLFLVQTIIILESSQVRYFTSDSQDYLIIASQRDDSELTQVFRWNGGSFVLHQKLPVRGVLTVALFNKGGSVFLAISQANARLNSLLFRWSGSGFINFQEVPVSGTTEVEALSSANDIYLIFAENVFLGDQNSIDIFIWEMGQSSFRYFQSVDFAAVNRIHSFTPASGIAHILLIGQDMSALYCWNSERNQFSFVLEVPSAYDVASVTVKSLNSSKNLIALVGAHSHIYELAYISSHSDFIPSSGELIFEPGEREATIAVNILDDTVPEKEESFKVQLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPDDLPELEEGFIVTITEVNLVNSDFSTGQPSVRRPGMEIAEIMIEENDDPRGIFMFHVTRGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVMIDESLSSDDPDSYVTLTVVRSPGGKGTVRLEWTIDEKAKHNLSPLNGTLHFDETESQKTIVLHTLQDTVLEEDRRFTIQLISIDEVEISPVKGSASIIIRGDKRASGEVGIAPSSRHILIGEPSAKYNGTAIISLVRGPGILGEVTVFWRIFPPSVGEFAETSGKLTMRDEQSAVIVVIQALNDDIPEEKSFYEFQLTAVSEGGVLSESSSTANITVVASDSPYGRFAFSHEQLRVSEAQRVNITIIRSSGDFGHVRLWYKTMSGTAEAGLDFVPAAGELLFEAGEMRKSLHVEILDDDYPEGPEEFSLTITKVELQGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEEKDDTGFAAFAMVIITGSDLHNGIIGFSEESQSGLELREGAVMRRLHLIVTRQPNRAFEDVKVFWRVTLNKTVVVLQKDGVNLVEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVVEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 3138 - protein, 1967 aa, Homo sapiens
  Payload ID: 699;
  Gene Symbol: ADGRV1;
  Gene Name: adhesion G prt-coupled receptor V1;
  Uniprot ID:  Q8WXG9;
  ENSP ID: ENSP00000392618
MQLCIFCCCCILFYFDLYDFGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEEKDDTGFAAFAMVIITGSDLHNGIIGFSEESQSGLELREGAVMRRLHLIVTRQPNRAFEDVKVFWRVTLNKTVVVLQKDGVNLVEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVVEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 3139 - protein, 1608 aa, Homo sapiens
  Payload ID: 699;
  Gene Symbol: ADGRV1;
  Gene Name: adhesion G prt-coupled receptor V1;
  ENSP ID: ENSP00000422153
  MOD_RES (1)..(1): Any amino acid
XLYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRLDSEGLTAQVIIDANDGARGVIEWQQSRFEVNETHGSLTLVAQRSREPLGHVSLFVYAQNLEAQVGLDYIFTPMILHFADGERYKNVNIMILDDDIPEGDEKFQLILTNPSPGLELGKNTIALIIVLANDDGPGVLSFNNSEHFFLREPTALYVQESVAVLYIVREPAQGLFGTVTVQFIVTEVNSSNESKDLTPSKGYIVLEEGVRFKALQISAILDTEPEMDEYFVCTLFNPTGGARLGVHVQTLITVLQNQAPLGLFSISAVENRATSIDIEEANRTVYLNVSRTNGIDLAVSVQWETVSETAFGMRGMDVVFSVFQSFLDESASGWCFFTLENLIYGIMLRKSSVTVYRWQGIFIPVEDLNIENPKTCEAFNIGFSPYFVITHEERNEEKPSLNSVFTFTSGFKLFLVQTIIILESSQVRYFTSDSQDYLIIASQRDDSELTQVFRWNGGSFVLHQKLPVRGVLTVALFNKGGSVFLAISQANARLNSLLFRWSGSGFINFQEVPVSGTTEVEALSSANDIYLIFAENVFLGDQNSIDIFIWEMGQSSFRYFQSVDFAAVNRIHSFTPASGIAHILLIGQDMSALYCWNSERNQFSFVLEVPSAYDVASVTVKSLNSSKNLIALVGAHSHIYELAYISSHSDFIPSSGELIFEPGEREATIAVNILDDTVPEKEESFKVQLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPDDLPELEEGFIVTITEVNLVNSDFSTGQPSVRRPGMEIAEIMIEENDDPRGIFMFHVTRGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVS

SEQ ID NO: 3140 - protein, 1055 aa, Homo sapiens
  Payload ID: 699;
  Gene Symbol: ADGRV1;
  Gene Name: adhesion G prt-coupled receptor V1;
  ENSP ID: ENSP00000424736
  MOD_RES (1)..(1): Any amino acid
XRYEEITVVRNGGTHGNVSANWVLTRNSTDPSPVTADIRPSSGVLHFAQGQMLATIPLTVVDDDLPEEAEAYLLQILPHTIRGGAEVSEPAELLFYIQDSDDVYGLITFFPMENQKIESSPGERYLSLSFTRLGGTKGDVRLLYSVLYIPAGAVDPLQAKEGILNISRRNDLIFPEQKTQVTTKLPIRNDAFLQNGAHFLVQLETVELLNIIPLIPPISPRFGEICNISLLVTPAIANGEIGFLSNLPIILHEPEDFAAEVVYIPLHRDGTDGQATVYWSLKPSGFNSKAVTPDDIGPFNGSVLFLSGQSDTTINITIKGDDIPEMNETVTLSLDRVNVENQVLKSGYTSRDLIILENDDPGGVFEFSPASRGPYVIKEGESVELHIIRSRGSLVKQFLHYRVEPRDSNEFYGNTGVLEFKPGEREIVITLLARLDGIPELDEHYWVVLSSHGERESKLGSATIVNITILKNDDPHGIIEFVSDGLIVMINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSTGDTVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGGSPGPGGQLAETNLQVTVMVPFNDDPFGVFILDPECLEREVAEDVLSEDDMSYITNFTILRQQGVFGDVQLGWEILSSEFPAGLPPMIDFLLVGIFPTTVHLQQHMRRHHSGTDALYFTGLEGAFGTVNPKYHPSRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGEGHHHN

SEQ ID NO: 3141 - protein, 148 aa, Homo sapiens
  Payload ID: 699;
  Gene Symbol: ADGRV1;
  Gene Name: adhesion G prt-coupled receptor V1;
  ENSP ID: ENSP00000425936
MAKRSAAAAVPGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPEPDETFIFHLTLQLPSIAVSEPKGRNESMPLTLIREKG

SEQ ID NO: 3142 - protein, 493 aa, Homo sapiens
  Payload ID: 700;
  Gene Symbol: AMIGO1;
  Gene Name: adhesion molecule with Ig-like domain 1;
  Uniprot ID:  Q86WK6;
  ENSP ID: ENSP00000358878
MHPHRDPRGLWLLLPSLSLLLFEVARAGRAVVSCPAACLCASNILSCSKQQLPNVPHSLPSYTALLDLSHNNLSRLRAEWTPTRLTQLHSLLLSHNHLNFISSEAFSPVPNLRYLDLSSNQLRTLDEFLFSDLQVLEVLLLYNNHIMAVDRCAFDDMAQLQKLYLSQNQISRFPLELVKEGAKLPKLTLLDLSSNKLKNLPLPDLQKLPAWIKNGLYLHNNPLNCDCELYQLFSHWQYRQLSSVMDFQEDLYCMNSKKLHNVFNLSFLNCGEYKERAWEAHLGDTLIIKCDTKQQGMTKVWVTPSNERVLDEVTNGTVSVSKDGSLLFQQVQVEDGGVYTCYAMGETFNETLSVELKVHNFTLHGHHDTLNTAYTTLVGCILSVVLVLIYLYLTPCRCWCRGVEKPSSHQGDSLSSSMLSTTPNHDPMAGGDKDDGFDRRVAFLEPAGPGQGQNGKLKPGNTLPVPEATGKGQRRMSDPESVSSVFSDTPIVV

SEQ ID NO: 3143 - protein, 493 aa, Homo sapiens; identical to SEQ ID NO: 3142
  Payload ID: 700;
  Gene Symbol: AMIGO1;
  Gene Name: adhesion molecule with Ig-like domain 1;
  Uniprot ID:  Q86WK6;
  ENSP ID: ENSP00000358880

SEQ ID NO: 3144 - protein, 522 aa, Homo sapiens
  Payload ID: 701;
  Gene Symbol: AMIGO2;
  Gene Name: adhesion molecule with Ig-like domain 2;
  Uniprot ID:  Q86SJ2;
  ENSP ID: ENSP00000266581
MSLRVHTLPTLLGAVVRPGCRELLCLLMITVTVGPGASGVCPTACICATDIVSCTNKNLSKVPGNLFRLIKRLDLSYNRIGLLDSEWIPVSFAKLNTLILRHNNITSISTGSFSTTPNLKCLDLSSNKLKTVKNAVFQELKVLEVLLLYNNHISYLDPSAFGGLSQLQKLYLSGNFLTQFPMDLYVGRFKLAELMFLDVSYNRIPSMPMHHINLVPGKQLRGIYLHGNPFVCDCSLYSLLVFWYRRHFSSVMDFKNDYTCRLWSDSRHSRQVLLLQDSFMNCSDSIINGSFRALGFIHEAQVGERLMVHCDSKTGNANTDFIWVGPDNRLLEPDKEMENFYVFHNGSLVIESPRFEDAGVYSCIAMNKQRLLNETVDVTINVSNFTVSRSHAHEAFNTAFTTLAACVASIVLVLLYLYLTPCPCKCKTKRQKNMLHQSNAHSSILSPGPASDASADERKAGAGKRVVFLEPLKDTAAGQNGKVRLFPSEAVIAEGILKSTRGKSDSDSVNSVFSDTPFVAST

SEQ ID NO: 3145 - protein, 522 aa, Homo sapiens; identical to SEQ ID NO: 3144
  Payload ID: 701;
  Gene Symbol: AMIGO2;
  Gene Name: adhesion molecule with Ig-like domain 2;
  Uniprot ID:  Q86SJ2;
  ENSP ID: ENSP00000406020

SEQ ID NO: 3146 - protein, 522 aa, Homo sapiens; identical to SEQ ID NO: 3144
  Payload ID: 701;
  Gene Symbol: AMIGO2;
  Gene Name: adhesion molecule with Ig-like domain 2;
  Uniprot ID:  Q86SJ2;
  ENSP ID: ENSP00000449034

SEQ ID NO: 3147 - protein, 504 aa, Homo sapiens
  Payload ID: 702;
  Gene Symbol: AMIGO3;
  Gene Name: adhesion molecule with Ig-like domain 3;
  Uniprot ID:  Q86WK7;
  ENSP ID: ENSP00000323096
MTWLVLLGTLLCMLRVGLGTPDSEGFPPRALHNCPYKCICAADLLSCTGLGLQDVPAELPAATADLDLSHNALQRLRPGWLAPLFQLRALHLDHNELDALGRGVFVNASGLRLLDLSSNTLRALGRHDLDGLGALEKLLLFNNRLVHLDEHAFHGLRALSHLYLGCNELASFSFDHLHGLSATHLLTLDLSSNRLGHISVPELAALPAFLKNGLYLHNNPLPCDCRLYHLLQRWHQRGLSAVRDFAREYVCLAFKVPASRVRFFQHSRVFENCSSAPALGLERPEEHLYALVGRSLRLYCNTSVPAMRIAWVSPQQELLRAPGSRDGSIAVLADGSLAIGNVQEQHAGLFVCLATGPRLHHNQTHEYNVSVHFPRPEPEAFNTGFTTLLGCAVGLVLVLLYLFAPPCRCCRRACRCRRWPQTPSPLQELSAQSSVLSTTPPDAPSRKASVHKHVVFLEPGRRGLNGRVQLAVAEEFDLYNPGGLQLKAGSESASSIGSEGPMTT

SEQ ID NO: 3148 - protein, 384 aa, Homo sapiens
  Payload ID: 703;
  Gene Symbol: AMICA1;
  Gene Name: adhesion molecule, interacts with CXADR antigen 1;
  Uniprot ID:  Q86YT9;
  ENSP ID: ENSP00000292067
MVSGDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 3149 - protein, 394 aa, Homo sapiens
  Payload ID: 703;
  Gene Symbol: AMICA1;
  Gene Name: adhesion molecule, interacts with CXADR antigen 1;
  Uniprot ID:  Q86YT9;
  ENSP ID: ENSP00000348635
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 3150 - protein, 355 aa, Homo sapiens
  Payload ID: 703;
  Gene Symbol: AMICA1;
  Gene Name: adhesion molecule, interacts with CXADR antigen 1;
  Uniprot ID:  Q86YT9;
  ENSP ID: ENSP00000431218
MGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 3151 - protein, 305 aa, Homo sapiens
  Payload ID: 703;
  Gene Symbol: AMICA1;
  Gene Name: adhesion molecule, interacts with CXADR antigen 1;
  ENSP ID: ENSP00000431614
MGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEVNTRFSLKH

SEQ ID NO: 3152 - protein, 155 aa, Homo sapiens
  Payload ID: 703;
  Gene Symbol: AMICA1;
  Gene Name: adhesion molecule, interacts with CXADR antigen 1;
  ENSP ID: ENSP00000431791
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGC

SEQ ID NO: 3153 - protein, 120 aa, Homo sapiens
  Payload ID: 703;
  Gene Symbol: AMICA1;
  Gene Name: adhesion molecule, interacts with CXADR antigen 1;
  ENSP ID: ENSP00000432769
MGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQS

SEQ ID NO: 3154 - protein, 66 aa, Homo sapiens
  Payload ID: 703;
  Gene Symbol: AMICA1;
  Gene Name: adhesion molecule, interacts with CXADR antigen 1;
  ENSP ID: ENSP00000435145
MFCPLKLILLPVLLEHRRQMYIQDRLDSVTRRARQGRICAILLLQSQCAYWALPEPRTLDGGHLMQ

SEQ ID NO: 3155 - protein, 383 aa, Homo sapiens
  Payload ID: 703;
  Gene Symbol: AMICA1;
  Gene Name: adhesion molecule, interacts with CXADR antigen 1;
  ENSP ID: ENSP00000436117
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 3156 - protein, 407 aa, Homo sapiens
  Payload ID: 704;
  Gene Symbol: ADRM1;
  Gene Name: adhesion regulating molecule 1;
  Uniprot ID:  Q16186;
  ENSP ID: ENSP00000253003
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 3157 - protein, 407 aa, Homo sapiens; identical to SEQ ID NO: 3156
  Payload ID: 704;
  Gene Symbol: ADRM1;
  Gene Name: adhesion regulating molecule 1;
  Uniprot ID:  Q16186;
  ENSP ID: ENSP00000478877

SEQ ID NO: 3158 - protein, 141 aa, Homo sapiens
  Payload ID: 704;
  Gene Symbol: ADRM1;
  Gene Name: adhesion regulating molecule 1;
  ENSP ID: ENSP00000479008
MTTSGALFPSLVPGSRGASNKYLVEFRAGKMSLKGTTVTPDKRKGLVYIQQTDDSLIHFCWKDRTSGNVEDEPKTDQDEEHCRKVNEYLNNPPMPGALGASGSSGHELSALGGEGGLQSLLGNMSHSQLMQLIGPAGLGGL

SEQ ID NO: 3159 - protein, 368 aa, Homo sapiens
  Payload ID: 704;
  Gene Symbol: ADRM1;
  Gene Name: adhesion regulating molecule 1;
  ENSP ID: ENSP00000480756
MTTSGALFPSLVPGSRGASNKYLVEFRAGKMSLKGTTVTPDKRKGLVYIQQTDDSLIHFCWKDRTSGNVEDEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 3160 - protein, 416 aa, Homo sapiens
  Payload ID: 705;
  Gene Symbol: APMAP;
  Gene Name: adipocyte plasma membrane associated prt;
  Uniprot ID:  Q9HDC9;
  ENSP ID: ENSP00000217456
MSEADGLRQRRPLRPQVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKLFSQETVMKFVPRYSLVLELSDSGAFRRSLHDPDGLVATYISEVHEHDGHLYLGSFRSPFLCRLSLQAV

SEQ ID NO: 3161 - protein, 409 aa, Homo sapiens
  Payload ID: 705;
  Gene Symbol: APMAP;
  Gene Name: adipocyte plasma membrane associated prt;
  ENSP ID: ENSP00000395874
  MOD_RES (1)..(1): Any amino acid
XVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKGSCAGCDLLFSQETVMKFVPRYSLVLELSDSGAFRRSLHDPDGLVATYISEVHEHDGHLYLGSFRSPFLCRLSLQAV

SEQ ID NO: 3162 - protein, 147 aa, Homo sapiens
  Payload ID: 706;
  Gene Symbol: AAMDC;
  Gene Name: adipogenesis associated, Mth938 domain containing;
  ENSP ID: ENSP00000307254
MTSPEIASLSWGQMKVKGSNTTYKDCKVWPGGSRTWDWRETGTEHSPGVQPADVKEVVEKGVQTLVIGRGMSEALKAPTQQLPSGVHVRAVVQFHLATASWHILERCKTGAGLSIKHVCELAMSHLSTFLYQIYDAIILKMHLYFMK

SEQ ID NO: 3163 - protein, 122 aa, Homo sapiens
  Payload ID: 706;
  Gene Symbol: AAMDC;
  Gene Name: adipogenesis associated, Mth938 domain containing;
  Uniprot ID:  Q9H7C9;
  ENSP ID: ENSP00000377078
MTSPEIASLSWGQMKVKGSNTTYKDCKVWPGGSRTWDWRETGTEHSPGVQPADVKEVVEKGVQTLVIGRGMSEALKVPSSTVEYLKKHGIDVRVLQTEQAVKEYNALVAQGVRVGGVFHSTC

SEQ ID NO: 3164 - protein, 122 aa, Homo sapiens; identical to SEQ ID NO: 3163
  Payload ID: 706;
  Gene Symbol: AAMDC;
  Gene Name: adipogenesis associated, Mth938 domain containing;
  Uniprot ID:  Q9H7C9;
  ENSP ID: ENSP00000431808

SEQ ID NO: 3165 - protein, 141 aa, Homo sapiens
  Payload ID: 706;
  Gene Symbol: AAMDC;
  Gene Name: adipogenesis associated, Mth938 domain containing;
  ENSP ID: ENSP00000432830
MRVEPSWPNQLLKTSVKFLMTSPEIASLSWGQMKVKGSNTTYKDCKVWPGGSRTWDWRETGTEHSPGVQPADVKEVVEKGVQTLVIGRGMSEALKVPSSTVEYLKKHGIDVRVLQTEQAVKEYNALVAQGVRVGGVFHSTC

SEQ ID NO: 3166 - protein, 137 aa, Homo sapiens
  Payload ID: 706;
  Gene Symbol: AAMDC;
  Gene Name: adipogenesis associated, Mth938 domain containing;
  ENSP ID: ENSP00000433281
MTSPEIASLSWGQMKVKGSNTTYKDCKVWPGGSRTWDWRETGTEHSPGVQPADVKEVVEKGVQTLVIGRGMSEALKAPTQQLPSGVHVRAVVQFHLATASWHILERCKTDQELEQLGVFSTLLWTGEGSWTEHQTCL

SEQ ID NO: 3167 - protein, 88 aa, Homo sapiens
  Payload ID: 706;
  Gene Symbol: AAMDC;
  Gene Name: adipogenesis associated, Mth938 domain containing;
  Uniprot ID:  Q9H7C9;
  ENSP ID: ENSP00000433293
MTSPEIASLSWGQMKVKGSNTTYKDCKVWPGGSRTWDWRETGTEHSPGVQPADVKEVVEKGVQTLVIGRGMSEALKDGIQGAQLDLNC

SEQ ID NO: 3168 - protein, 90 aa, Homo sapiens
  Payload ID: 706;
  Gene Symbol: AAMDC;
  Gene Name: adipogenesis associated, Mth938 domain containing;
  ENSP ID: ENSP00000433956
MTSPEIASLSWGQMKVKGSNTTYKDCKVWPGGSRTWDWRETGTEVPSSTVEYLKKHGIDVRVLQTEQAVKEYNALVAQGVRVGGVFHSTC

SEQ ID NO: 3169 - protein, 93 aa, Homo sapiens
  Payload ID: 706;
  Gene Symbol: AAMDC;
  Gene Name: adipogenesis associated, Mth938 domain containing;
  ENSP ID: ENSP00000435560
MTSPEIASLSWGQMKVKGSNTTYKDCKVWPGGSRTWDWRETGTEHSPGVQPADVKEVVEKGVQTLVIGRGMSEALKGLTLPPRLECSGTIITH

SEQ ID NO: 3170 - protein, 168 aa, Homo sapiens
  Payload ID: 706;
  Gene Symbol: AAMDC;
  Gene Name: adipogenesis associated, Mth938 domain containing;
  ENSP ID: ENSP00000436086
MTSPEIASLSWGQMKVKGSNTTYKDCKVWPGGSRTWDWRETGTESLTLLPRLECSGAISAHCNLHLPGSCHSPASASQVAGTTGACHHTQHSPGVQPADVKEVVEKGVQTLVIGRGMSEALKVPSSTVEYLKKHGIDVRVLQTEQAVKEYNALVAQGVRVGGVFHSTC

SEQ ID NO: 3171 - protein, 51 aa, Homo sapiens
  Payload ID: 706;
  Gene Symbol: AAMDC;
  Gene Name: adipogenesis associated, Mth938 domain containing;
  ENSP ID: ENSP00000437120
RLQPSSCHQVFMSGLWYNSTWLQLHGTSLRDAKQGLTLPPRLECSGTIITH

SEQ ID NO: 3172 - protein, 147 aa, Homo sapiens; identical to SEQ ID NO: 3162
  Payload ID: 706;
  Gene Symbol: AAMDC;
  Gene Name: adipogenesis associated, Mth938 domain containing;
  ENSP ID: ENSP00000486080

SEQ ID NO: 3173 - protein, 76 aa, Homo sapiens
  Payload ID: 707;
  Gene Symbol: ADIRF;
  Gene Name: adipogenesis regulatory factor;
  Uniprot ID:  Q15847;
  ENSP ID: ENSP00000361083
MASKGLQDLKQQVEGTAQEAVSAAGAAAQQVVDQATEAGQKAMDQLAKTTQETIDKTANQASDTFSGIGKKFGLLK

SEQ ID NO: 3174 - protein, 38 aa, Homo sapiens
  Payload ID: 707;
  Gene Symbol: ADIRF;
  Gene Name: adipogenesis regulatory factor;
  ENSP ID: ENSP00000394643
MASKGLQDLKQQVEGTAQEAAMDQLAKTTQETIDKTAN

SEQ ID NO: 3175 - protein, 76 aa, Homo sapiens; identical to SEQ ID NO: 3173
  Payload ID: 707;
  Gene Symbol: ADIRF;
  Gene Name: adipogenesis regulatory factor;
  Uniprot ID:  Q15847;
  ENSP ID: ENSP00000475582

SEQ ID NO: 3176 - protein, 59 aa, Homo sapiens
  Payload ID: 708;
  Gene Symbol: ADIG;
  Gene Name: adipogenin;
  ENSP ID: ENSP00000362445
MKYPLMPLVNDLTFSFLVFWFCLPVGLLLLLIIWLRFLLSQDILQVRRYRYDANILTAS

SEQ ID NO: 3177 - protein, 179 aa, Homo sapiens
  Payload ID: 708;
  Gene Symbol: ADIG;
  Gene Name: adipogenin;
  ENSP ID: ENSP00000416834
  MOD_RES (1)..(1): Any amino acid
XWFCLPVGLLLLLIIWLRFLLSQDSEENDSSVCLDWEPWSKGPAEFCWKGTLHGQEKERPCCLVFLESAGQWQWQKWMGETCQGGKRTLATVVPPWNPQLISSSDRHVKASRGPSPSPASQMTSSPAGSRSSLGGHGSSEQAHGEKLANLIQRGLKAGLGRRVWVHIKEARVFPYPGDP

SEQ ID NO: 3178 - protein, 80 aa, Homo sapiens
  Payload ID: 708;
  Gene Symbol: ADIG;
  Gene Name: adipogenin;
  Uniprot ID:  Q0VDE8;
  ENSP ID: ENSP00000434385
MKYPLMPLVNDLTFSFLVFWFCLPVGLLLLLIIWLRFLLSQDSEENDSSVCLDWEPWSKGPAEFCWKGTLHGQEKERPCW

SEQ ID NO: 3179 - protein, 80 aa, Homo sapiens; identical to SEQ ID NO: 3178
  Payload ID: 708;
  Gene Symbol: ADIG;
  Gene Name: adipogenin;
  Uniprot ID:  Q0VDE8;
  ENSP ID: ENSP00000440331

SEQ ID NO: 3180 - protein, 375 aa, Homo sapiens
  Payload ID: 709;
  Gene Symbol: ADIPOR1;
  Gene Name: adiponectin receptor 1;
  Uniprot ID:  Q96A54;
  ENSP ID: ENSP00000341785
MSSHKGSVVAQGNGAPASNREADTVELAELGPLLEEKGKRVIANPPKAEEEQTCPVPQEEEEEVRVLTLPLQAHHAMEKMEEFVYKVWEGRWRVIPYDVLPDWLKDNDYLLHGHRPPMPSFRACFKSIFRIHTETGNIWTHLLGFVLFLFLGILTMLRPNMYFMAPLQEKVVFGMFFLGAVLCLSFSWLFHTVYCHSEKVSRTFSKLDYSGIALLIMGSFVPWLYYSFYCSPQPRLIYLSIVCVLGISAIIVAQWDRFATPKHRQTRAGVFLGLGLSGVVPTMHFTIAEGFVKATTVGQMGWFFLMAVMYITGAGLYAARIPERFFPGKFDIWFQSHQIFHVLVVAAAFVHFYGVSNLQEFRYGLEGGCTDDTLL

SEQ ID NO: 3181 - protein, 171 aa, Homo sapiens
  Payload ID: 709;
  Gene Symbol: ADIPOR1;
  Gene Name: adiponectin receptor 1;
  ENSP ID: ENSP00000356223
MSSHKGSVVAQGNGAPASNREADTVELAELGPLLEEKGKRVIANPPKAEEEQTCPVPQEEEEEVRVLTLPLQAHHAMEKMEEFVYKVWEGRWRVIPYDVLPDWLKDNDYLLHGHRPPMPSFRACFKSIFRIHTETGNIWTHLLATAHLPLHRLCPGHFCHHCGAVGPVCHS

SEQ ID NO: 3182 - protein, 205 aa, Homo sapiens
  Payload ID: 709;
  Gene Symbol: ADIPOR1;
  Gene Name: adiponectin receptor 1;
  ENSP ID: ENSP00000392946
MSSHKGSVVAQGNGAPASNREADTVELAELGPLLEEKGKRVIANPPKAEEEQTCPVPQEEEEEVRVLTLPLQAHHAMEKMEEFVYKVWEGRWRVIPYDVLPDWLKDNDYLLHGHRPPMPSFRACFKSIFRIHTETGNIWTHLLGFVLFLFLGILTMLRPNMYFMAPLQEKVVFGMFFLGAVLCLSFSWLFHTVYCHSEKVSRTFS

SEQ ID NO: 3183 - protein, 266 aa, Homo sapiens
  Payload ID: 709;
  Gene Symbol: ADIPOR1;
  Gene Name: adiponectin receptor 1;
  ENSP ID: ENSP00000402178
MSSHKGSVVAQGNGAPASNREADTVELAELGPLLEEKGKRVIANPPKAEEEQTCPVPQEEEEEVRVLTLPLQAHHAMEKMEEFVYKVWEGRWRVIPYDVLPDWLKDNDYLLHGHRPPMPSFRACFKSIFRIHTETGNIWTHLLGFVLFLFLGILTMLRPNMYFMAPLQEKVVFGMFFLGAVLCLSFSWLFHTVYCHSEKVSRTFSKLDYSGIALLIMGSFVPWLYYSFYCSPQPRLIYLSIVCVLGISAIIVAQWDRFATPKHRQT

SEQ ID NO: 3184 - protein, 386 aa, Homo sapiens
  Payload ID: 710;
  Gene Symbol: ADIPOR2;
  Gene Name: adiponectin receptor 2;
  Uniprot ID:  Q86V24;
  ENSP ID: ENSP00000349616
MNEPTENRLGCSRTPEPDIRLRKGHQLDGTRRGDNDSHQGDLEPILEASVLSSHHKKSSEEHEYSDEAPQEDEGFMGMSPLLQAHHAMEKMEEFVCKVWEGRWRVIPHDVLPDWLKDNDFLLHGHRPPMPSFRACFKSIFRIHTETGNIWTHLLGCVFFLCLGIFYMFRPNISFVAPLQEKVVFGLFFLGAILCLSFSWLFHTVYCHSEGVSRLFSKLDYSGIALLIMGSFVPWLYYSFYCNPQPCFIYLIVICVLGIAAIIVSQWDMFATPQYRGVRAGVFLGLGLSGIIPTLHYVISEGFLKAATIGQIGWLMLMASLYITGAALYAARIPERFFPGKCDIWFHSHQLFHIFVVAGAFVHFHGVSNLQEFRFMIGGGCSEEDAL

SEQ ID NO: 3185 - protein, 244 aa, Homo sapiens
  Payload ID: 711;
  Gene Symbol: ADIPOQ;
  Gene Name: adiponectin, C1Q and collagen domain containing;
  Uniprot ID:  Q15848;
  ENSP ID: ENSP00000320709
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSVLLHLEVGDQVWLQVYGEGERNGLYADNDNDSTFTGFLLYHDTN

SEQ ID NO: 3186 - protein, 244 aa, Homo sapiens; identical to SEQ ID NO: 3185
  Payload ID: 711;
  Gene Symbol: ADIPOQ;
  Gene Name: adiponectin, C1Q and collagen domain containing;
  Uniprot ID:  Q15848;
  ENSP ID: ENSP00000389814

SEQ ID NO: 3187 - protein, 1131 aa, Homo sapiens
  Payload ID: 712;
  Gene Symbol: ADNP2;
  Gene Name: ADNP homeobox 2;
  Uniprot ID:  Q6IQ32;
  ENSP ID: ENSP00000262198
MFQIPVENLDNIRKVRKKVKGILVDIGLDSCKELLKDLKGFDPGEKYFHNTSWGDVSLWEPSGKKVRYRTKPYCCGLCKYSTKVLTSFKNHLHRYHEDEIDQELVIPCPNCVFASQPKVVGRHFRMFHAPVRKVQNYTVNILGETKSSRSDVISFTCLKCNFSNTLYYSMKKHVLVAHFHYLINSYFGLRTEEMGEQPKTNDTVSIEKIPPPDKYYCKKCNANASSQDALMYHILTSDIHRDLENKLRSVISEHIKRTGLLKQTHIAPKPAAHLAAPANGSAPSAPAQPPCFHLALPQNSPSPAAGQPVTVAQGAPGSLTHSPPAAGQSHMTLVSSPLPVGQNSLTLQPPAPQPVFLSHGVPLHQSVNPPVLPLSQPVGPVNKSVGTSVLPINQTVRPGVLPLTQPVGPINRPVGPGVLPVSPSVTPGVLQAVSPGVLSVSRAVPSGVLPAGQMTPAGQMTPAGVIPGQTATSGVLPTGQMVQSGVLPVGQTAPSRVLPPGQTAPLRVISAGQVVPSGLLSPNQTVSSSAVVPVNQGVNSGVLQLSQPVVSGVLPVGQPVRPGVLQLNQTVGTNILPVNQPVRPGASQNTTFLTSGSILRQLIPTGKQVNGIPTYTLAPVSVTLPVPPGGLATVAPPQMPIQLLPSGAAAPMAGSMPGMPSPPVLVNAAQSVFVQASSSAADTNQVLKQAKQWKTCPVCNELFPSNVYQVHMEVAHKHSESKSGEKLEPEKLAACAPFLKWMREKTVRCLSCKCLVSEEELIHHLLMHGLGCLFCPCTFHDIKGLSEHSRNRHLGKKKLPMDYSNRGFQLDVDANGNLLFPHLDFITILPKEKLGEREVYLAILAGIHSKSLVPVYVKVRPQAEGTPGSTGKRVSTCPFCFGPFVTTEAYELHLKERHHIMPTVHTVLKSPAFKCIHCCGVYTGNMTLAAIAVHLVRCRSAPKDSSSDLQAQPGFIHNSELLLVSGEVMHDSSFSVKRKLPDGHLGAEDQRHGEEQPPILNADAAPGPEKVTSVVPFKRQRNESRTEGPIVKDEALQILALDPKKYEGRSYEEKKQFLKDYFHKKPYPSKKEIELLSSLFWVWKIDVASFFGKRRYICMKAIKNHKPSVLLGFDMSELKNVKHRLNFEYEP

SEQ ID NO: 3188 - protein, 171 aa, Homo sapiens
  Payload ID: 712;
  Gene Symbol: ADNP2;
  Gene Name: ADNP homeobox 2;
  ENSP ID: ENSP00000453275
MFQIPVENLDNIRKVRKKVKGILVDIGLDSCKELLKDLKGFDPGEKYFHNTSWGDVSLWEPSGKKVRYRTKPYCCGLCKYSTKVLTSFKNHLHRYHEDEIDQELVIPCPNCVFASQPKVVGRHFRMFHAPVRKVQNYTVNILGETKSSRSDVISFTCLKCNFSNTLYYSMK

SEQ ID NO: 3189 - protein, 229 aa, Homo sapiens
  Payload ID: 712;
  Gene Symbol: ADNP2;
  Gene Name: ADNP homeobox 2;
  ENSP ID: ENSP00000453418
MFQIPVENLDNIRKDLKGFDPGEKYFHNTSWGDVSLWEPSGKKVRYRTKPYCCGLCKYSTKVLTSFKNHLHRYHEDEIDQELVIPCPNCVFASQPKVVGRHFRMFHAPVRKVQNYTVNILGETKSSRSDVISFTCLKCNFSNTLYYSMKKHVLVAHFHYLINSYFGLRTEEMGEQPKTNDTVSIEKIPPPDKYYCKKCNANASSQDALMYHILTSDIHRDLENKLRSVI

SEQ ID NO: 3190 - protein, 26 aa, Homo sapiens
  Payload ID: 712;
  Gene Symbol: ADNP2;
  Gene Name: ADNP homeobox 2;
  ENSP ID: ENSP00000467370
  MOD_RES (1)..(1): Any amino acid
XIGLDSCKELLKPDRKSGALRCVRAF

SEQ ID NO: 3191 - protein, 82 aa, Homo sapiens
  Payload ID: 712;
  Gene Symbol: ADNP2;
  Gene Name: ADNP homeobox 2;
  ENSP ID: ENSP00000468397
  MOD_RES (1)..(1): Any amino acid
XLVDIGLDSCKELLKDLKGFDPGEKYFHNTSWGDVSLWEPSGKKVLLAPSSVSDSAHPRLDLAVPSHQLLWSKSCWPWEFGL

SEQ ID NO: 3192 - protein, 496 aa, Homo sapiens
  Payload ID: 713;
  Gene Symbol: ADPGK;
  Gene Name: ADP-dependent glucokinase;
  Uniprot ID:  Q9BRR6;
  ENSP ID: ENSP00000312250
MALWRGSAYAGFLALAVGCVFLLEPELPGSALRSLWSSLCLGPAPAPPGPVSPEGRLAAAWDALIVRPVRRWRRVAVGVNACVDVVLSGVKLLQALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 3193 - protein, 222 aa, Homo sapiens
  Payload ID: 713;
  Gene Symbol: ADPGK;
  Gene Name: ADP-dependent glucokinase;
  Uniprot ID:  Q9BRR6;
  ENSP ID: ENSP00000397694
MAASCRVVTSISDIPTGIPVHLELASMTNRELMSSIVHQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 3194 - protein, 78 aa, Homo sapiens
  Payload ID: 713;
  Gene Symbol: ADPGK;
  Gene Name: ADP-dependent glucokinase;
  Uniprot ID:  Q9BRR6;
  ENSP ID: ENSP00000454304
MALWRGSAYAGFLALAVGCVFLLEPELPGSALRSLWSSLCLGPAPAPPGPVSPEGRLAAAWDALIVRPVRRWRRVAVG

SEQ ID NO: 3195 - protein, 78 aa, Homo sapiens; identical to SEQ ID NO: 3194
  Payload ID: 713;
  Gene Symbol: ADPGK;
  Gene Name: ADP-dependent glucokinase;
  Uniprot ID:  Q9BRR6;
  ENSP ID: ENSP00000454367

SEQ ID NO: 3196 - protein, 113 aa, Homo sapiens
  Payload ID: 713;
  Gene Symbol: ADPGK;
  Gene Name: ADP-dependent glucokinase;
  ENSP ID: ENSP00000454707
MALWRGSAYAGFLALAVGCVFLLEPELPGSALRSLWSSLCLGPAPAPPGPVSPEGRLAAAWDALIVRPVRRWRRVAVGFFFAVQLVQSYMSFLMTMSLFHQSHCRKWMSSTSF

SEQ ID NO: 3197 - protein, 204 aa, Homo sapiens
  Payload ID: 713;
  Gene Symbol: ADPGK;
  Gene Name: ADP-dependent glucokinase;
  ENSP ID: ENSP00000456387
  MOD_RES (1)..(1): Any amino acid
XEPELPGSALRSLWSSLCLGPAPAPPGPVSPEGRLAAAWDALIVRPVRRWRRVAVGVNACVDVVLSGVKLLQALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAAGLSRGDFPWAE

SEQ ID NO: 3198 - protein, 57 aa, Homo sapiens
  Payload ID: 713;
  Gene Symbol: ADPGK;
  Gene Name: ADP-dependent glucokinase;
  ENSP ID: ENSP00000457175
LLEPELPGSALRSLWSSLCLGPAPAPPGPVSPEGRLAAAWDALIVRPVRRWRRVAVG

SEQ ID NO: 3199 - protein, 154 aa, Homo sapiens
  Payload ID: 713;
  Gene Symbol: ADPGK;
  Gene Name: ADP-dependent glucokinase;
  ENSP ID: ENSP00000457447
MGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRK

SEQ ID NO: 3200 - protein, 26 aa, Homo sapiens
  Payload ID: 713;
  Gene Symbol: ADPGK;
  Gene Name: ADP-dependent glucokinase;
  ENSP ID: ENSP00000457572
  MOD_RES (1)..(1): Any amino acid
XKRLLEVLASQGHILAAGCGACLLLQ

SEQ ID NO: 3201 - protein, 78 aa, Homo sapiens; identical to SEQ ID NO: 3194
  Payload ID: 713;
  Gene Symbol: ADPGK;
  Gene Name: ADP-dependent glucokinase;
  Uniprot ID:  Q9BRR6;
  ENSP ID: ENSP00000458102

SEQ ID NO: 3202 - protein, 342 aa, Homo sapiens
  Payload ID: 714;
  Gene Symbol: ADPRM;
  Gene Name: ADP-ribose/CDP-alcohol diphosphatase, manganese-dependent;
  Uniprot ID:  Q3LIE5;
  ENSP ID: ENSP00000369099
MDDKPNPEALSDSSERLFSFGVIADVQFADLEDGFNFQGTRRRYYRHSLLHLQGAIEDWNNESSMPCCVLQLGDIIDGYNAQYNASKKSLELVMDMFKRLKVPVHHTWGNHEFYNFSREYLTHSKLNTKFLEDQIVHHPETMPSEDYYAYHFVPFPKFRFILLDAYDLSVLGVDQSSPKYEQCMKILREHNPNTELNSPQGLSEPQFVQFNGGFSQEQLNWLNEVLTFSDTNQEKVVIVSHLPIYPDASDNVCLAWNYRDALAVIWSHECVVCFFAGHTHDGGYSEDPFGVYHVNLEGVIETAPDSQAFGTVHVYPDKMMLKGRGRVPDRIMNYKKERAFHC

SEQ ID NO: 3203 - protein, 205 aa, Homo sapiens
  Payload ID: 714;
  Gene Symbol: ADPRM;
  Gene Name: ADP-ribose/CDP-alcohol diphosphatase, manganese-dependent;
  Uniprot ID:  Q3LIE5;
  ENSP ID: ENSP00000431622
MDDKPNPEALSDSSERLFSFGVIADVQFADLEDGFNFQGTRRRYYRHSLLHLQGAIEDWNNESSMPCCVLQLGDIIDGYNAQYNASKKSLELVMDMFKRLKVPVHHTWGNHEFYNFSREYLTHSKLNTKFLEDQIVHHPETMPSEDYYAYHFVPFPKFRFILLDAYDLSVLGVDQSSPKYEQCMKILREHNPNTELNSPQGELFL

SEQ ID NO: 3204 - protein, 294 aa, Homo sapiens
  Payload ID: 714;
  Gene Symbol: ADPRM;
  Gene Name: ADP-ribose/CDP-alcohol diphosphatase, manganese-dependent;
  ENSP ID: ENSP00000477021
MDDKPNPEALSDSSERLFSFGVIADVQFADLEDGFNFQGTRRRYYRHSLLHLQGAIEDWNNESSMPCCVLQLGDIIDGYNAQYNASKKSLELVMDMFKRLKVPVHHTWGNHEFYNFSREYLTHSKLNTKFLEDQIVHHPETMPSEDYYAYHFVPFPKFRFILLDAYDLSVLGVDQSSPKYEQCMKILREHNPNTELNSPQGLSEPQFVQFNGGFSQEQLNWLNEVLTFSDTNQEKVVIAIFPFTRTPLTMCAWPGTTEMPWQSFGLMSVWCVSLLVTPMMVATLRILLVYTTST

SEQ ID NO: 3205 - protein, 357 aa, Homo sapiens
  Payload ID: 715;
  Gene Symbol: ADPRH;
  Gene Name: ADP-ribosylarginine hydrolase;
  Uniprot ID:  P54922;
  ENSP ID: ENSP00000349496
MEKYVAAMVLSAAGDALGYYNGKWEFLQDGEKIHRQLAQLGGLDALDVGRWRVSDDTVMHLATAEALVEAGKAPKLTQLYYLLAKHYQDCMEDMDGRAPGGASVHNAMQLKPGKPNGWRIPFNSHEGGCGAAMRAMCIGLRFPHHSQLDTLIQVSIESGRMTHHHPTGYLGALASALFTAYAVNSRPPLQWGKGLMELLPEAKKYIVQSGYFVEENLQHWSYFQTKWENYLKLRGILDGESAPTFPESFGVKERDQFYTSLSYSGWGGSSGHDAPMIAYDAVLAAGDSWKELAHRAFFHGGDSDSTAAIAGCWWGVMYGFKGVSPSNYEKLEYRNRLEETARALYSLGSKEDTVISL

SEQ ID NO: 3206 - protein, 357 aa, Homo sapiens; identical to SEQ ID NO: 3205
  Payload ID: 715;
  Gene Symbol: ADPRH;
  Gene Name: ADP-ribosylarginine hydrolase;
  Uniprot ID:  P54922;
  ENSP ID: ENSP00000417430

SEQ ID NO: 3207 - protein, 357 aa, Homo sapiens; identical to SEQ ID NO: 3205
  Payload ID: 715;
  Gene Symbol: ADPRH;
  Gene Name: ADP-ribosylarginine hydrolase;
  Uniprot ID:  P54922;
  ENSP ID: ENSP00000417528

SEQ ID NO: 3208 - protein, 125 aa, Homo sapiens
  Payload ID: 715;
  Gene Symbol: ADPRH;
  Gene Name: ADP-ribosylarginine hydrolase;
  ENSP ID: ENSP00000419703
MEKYVAAMVLSAAGDALGYYNGKWEFLQDGEKIHRQLAQLGGLDALDVGRWRVSDDTVMHLATAEALVEAGKAPKLTQLYYLLAKHYQDCMEDMDGRAPGGASVHNAMQLKPGKPNGWRIPFNSH

SEQ ID NO: 3209 - protein, 357 aa, Homo sapiens; identical to SEQ ID NO: 3205
  Payload ID: 715;
  Gene Symbol: ADPRH;
  Gene Name: ADP-ribosylarginine hydrolase;
  Uniprot ID:  P54922;
  ENSP ID: ENSP00000420200

SEQ ID NO: 3210 - protein, 181 aa, Homo sapiens
  Payload ID: 716;
  Gene Symbol: ARF1;
  Gene Name: ADP-ribosylation  factor 1;
  Uniprot ID:  P84077;
  ENSP ID: ENSP00000272102
MGNIFANLFKGLFGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLSNQLRNQK

SEQ ID NO: 3211 - protein, 181 aa, Homo sapiens; identical to SEQ ID NO: 3210
  Payload ID: 716;
  Gene Symbol: ARF1;
  Gene Name: ADP-ribosylation  factor 1;
  Uniprot ID:  P84077;
  ENSP ID: ENSP00000440005

SEQ ID NO: 3212 - protein, 181 aa, Homo sapiens; identical to SEQ ID NO: 3210
  Payload ID: 716;
  Gene Symbol: ARF1;
  Gene Name: ADP-ribosylation  factor 1;
  Uniprot ID:  P84077;
  ENSP ID: ENSP00000442980

SEQ ID NO: 3213 - protein, 181 aa, Homo sapiens
  Payload ID: 717;
  Gene Symbol: ARF3;
  Gene Name: ADP-ribosylation  factor 3;
  Uniprot ID:  P61204;
  ENSP ID: ENSP00000256682
MGNIFGNLLKSLIGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 3214 - protein, 144 aa, Homo sapiens
  Payload ID: 717;
  Gene Symbol: ARF3;
  Gene Name: ADP-ribosylation  factor 3;
  Uniprot ID:  P61204;
  ENSP ID: ENSP00000395370
MGNIFGNLLKSLIGKKEMRILMVGLDAAGKTTILYKLKLGEIVTTIPTIGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 3215 - protein, 50 aa, Homo sapiens
  Payload ID: 717;
  Gene Symbol: ARF3;
  Gene Name: ADP-ribosylation  factor 3;
  ENSP ID: ENSP00000437374
MGNIFGNLLKSLIGKKEMRILMVGLDAAGKTTILYKLKLGEIVTTIPTIG

SEQ ID NO: 3216 - protein, 102 aa, Homo sapiens
  Payload ID: 717;
  Gene Symbol: ARF3;
  Gene Name: ADP-ribosylation  factor 3;
  ENSP ID: ENSP00000438063
MGNIFGNLLKSLIGKKEMRILMVGLDAAGKTTILYKLKLGEIVTTIPTIGFNVETVEYKNISFTVWDVGGQDKIRPLWRHYFQNTQGLIFVVDSNDRERVNE

SEQ ID NO: 3217 - protein, 181 aa, Homo sapiens; identical to SEQ ID NO: 3213
  Payload ID: 717;
  Gene Symbol: ARF3;
  Gene Name: ADP-ribosylation  factor 3;
  Uniprot ID:  P61204;
  ENSP ID: ENSP00000438510

SEQ ID NO: 3218 - protein, 40 aa, Homo sapiens
  Payload ID: 717;
  Gene Symbol: ARF3;
  Gene Name: ADP-ribosylation  factor 3;
  ENSP ID: ENSP00000446353
MGNIFGNLLKSLIGKKEMRILMVGLDAAGKTTILYKLKLG

SEQ ID NO: 3219 - protein, 180 aa, Homo sapiens
  Payload ID: 718;
  Gene Symbol: ARF4;
  Gene Name: ADP-ribosylation  factor 4;
  Uniprot ID:  P18085;
  ENSP ID: ENSP00000306010
MGLTISSLFSRLFGKKQMRILMVGLDAAGKTTILYKLKLGEIVTTIPTIGFNVETVEYKNICFTVWDVGGQDRIRPLWKHYFQNTQGLIFVVDSNDRERIQEVADELQKMLLVDELRDAVLLLFANKQDLPNAMAISEMTDKLGLQSLRNRTWYVQATCATQGTGLYEGLDWLSNELSKR

SEQ ID NO: 3220 - protein, 153 aa, Homo sapiens
  Payload ID: 718;
  Gene Symbol: ARF4;
  Gene Name: ADP-ribosylation  factor 4;
  ENSP ID: ENSP00000417501
MGLTISSLFSRLFGKKQMRILMGFNVETVEYKNICFTVWDVGGQDRIRPLWKHYFQNTQGLIFVVDSNDRERIQEVADELQKMLLVDELRDAVLLLFANKQDLPNAMAISEMTDKLGLQSLRNRTWYVQATCATQGTGLYEGLDWLSNELSKR

SEQ ID NO: 3221 - protein, 22 aa, Homo sapiens
  Payload ID: 718;
  Gene Symbol: ARF4;
  Gene Name: ADP-ribosylation  factor 4;
  ENSP ID: ENSP00000418388
MGLTISSLFSRLFGKKQMRILM

SEQ ID NO: 3222 - protein, 127 aa, Homo sapiens
  Payload ID: 718;
  Gene Symbol: ARF4;
  Gene Name: ADP-ribosylation  factor 4;
  ENSP ID: ENSP00000420254
MGLTISSLFSRLFGKKQMRILMVGLDAAGKTTILYKLKLGEIVTTIPTIGFNVETVEYKNICFTVWDVGGQDRIRPLWKHYFQNTQGLIFVVDSNDRERIQEVADELQKMLLVDELRDAVLLLFANK

SEQ ID NO: 3223 - protein, 59 aa, Homo sapiens
  Payload ID: 718;
  Gene Symbol: ARF4;
  Gene Name: ADP-ribosylation  factor 4;
  ENSP ID: ENSP00000420655
MGLTISSLFSRLFGKKQMRILMVGLDAAGKTTILYKLKLGEIVTTIPTIAVIFVFLCRF

SEQ ID NO: 3224 - protein, 71 aa, Homo sapiens
  Payload ID: 718;
  Gene Symbol: ARF4;
  Gene Name: ADP-ribosylation  factor 4;
  ENSP ID: ENSP00000475828
MLLVDELRDAVLLLFANKQDLPNAMAISEMTDKLGLQSLRNRTWYVQATCATQGTGLYEGLDWLSNELSKR

SEQ ID NO: 3225 - protein, 180 aa, Homo sapiens
  Payload ID: 719;
  Gene Symbol: ARF5;
  Gene Name: ADP-ribosylation  factor 5;
  Uniprot ID:  P84085;
  ENSP ID: ENSP00000000233
MGLTVSALFSRIFGKKQMRILMVGLDAAGKTTILYKLKLGEIVTTIPTIGFNVETVEYKNICFTVWDVGGQDKIRPLWRHYFQNTQGLIFVVDSNDRERVQESADELQKMLQEDELRDAVLLVFANKQDMPNAMPVSELTDKLGLQHLRSRTWYVQATCATQGTGLYDGLDWLSHELSKR

SEQ ID NO: 3226 - protein, 150 aa, Homo sapiens
  Payload ID: 719;
  Gene Symbol: ARF5;
  Gene Name: ADP-ribosylation  factor 5;
  ENSP ID: ENSP00000412701
MGLTVSALFSRIFGKKQMRILMVGLDAAGKTTILYKLKLGEIVTTIPTIGFNVETVEYKNICFTVWDVGGQDKIRPLWRHYFQNTQGLIFVVDSNDRERVQESADELQKMEDELRDAVLLVFANKQDMPNAMPVSELTDKLGLQHLRSRT

SEQ ID NO: 3227 - protein, 175 aa, Homo sapiens
  Payload ID: 720;
  Gene Symbol: ARF6;
  Gene Name: ADP-ribosylation  factor 6;
  Uniprot ID:  P62330;
  ENSP ID: ENSP00000298316
MGKVLSKIFGNKEMRILMLGLDAAGKTTILYKLKLGQSVTTIPTVGFNVETVTYKNVKFNVWDVGGQDKIRPLWRHYYTGTQGLIFVVDCADRDRIDEARQELHRIINDREMRDAIILIFANKQDLPDAMKPHEIQEKLGLTRIRDRNWYVQPSCATSGDGLYEGLTWLTSNYKS

SEQ ID NO: 3228 - protein, 414 aa, Homo sapiens
  Payload ID: 721;
  Gene Symbol: ARFGAP1;
  Gene Name: ADP-ribosylation  factor GTPase activating prt 1;
  Uniprot ID:  Q8N6T3;
  ENSP ID: ENSP00000314615
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKFWGHKQQPEPASELGHSLNENVLKPAQEKVKEGKIFDDVSSGVSQLASKGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 3229 - protein, 403 aa, Homo sapiens
  Payload ID: 721;
  Gene Symbol: ARFGAP1;
  Gene Name: ADP-ribosylation  factor GTPase activating prt 1;
  Uniprot ID:  Q8N6T3;
  ENSP ID: ENSP00000359298
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKASELGHSLNENVLKPAQEKVKEGKIFDDVSSGVSQLASKCQRRLCCHQSHCSAGHLGRAFCPVSWHEALCGQTGREEQASLLPPKHVVGALEVCARGCPRCHVPHTPGTAAEWPGRLCLSRESVVRDGGTSPPFFRGKQRAPWTAPRRATVIRTAVWTTSKTAT

SEQ ID NO: 3230 - protein, 406 aa, Homo sapiens
  Payload ID: 721;
  Gene Symbol: ARFGAP1;
  Gene Name: ADP-ribosylation  factor GTPase activating prt 1;
  Uniprot ID:  Q8N6T3;
  ENSP ID: ENSP00000359306
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKASELGHSLNENVLKPAQEKVKEGKIFDDVSSGVSQLASKVQGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 3231 - protein, 130 aa, Homo sapiens
  Payload ID: 721;
  Gene Symbol: ARFGAP1;
  Gene Name: ADP-ribosylation  factor GTPase activating prt 1;
  ENSP ID: ENSP00000427717
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKSLWPAAECDRLLGQGF

SEQ ID NO: 3232 - protein, 79 aa, Homo sapiens
  Payload ID: 721;
  Gene Symbol: ARFGAP1;
  Gene Name: ADP-ribosylation  factor GTPase activating prt 1;
  ENSP ID: ENSP00000428355
MASPRTRKVLKEVRVQDENNVCFECGAFNPQWVSVTYGIWICLECSGRHRGLGVHLSFVRSVTMDKWKDIELEKMKAGG

SEQ ID NO: 3233 - protein, 244 aa, Homo sapiens
  Payload ID: 721;
  Gene Symbol: ARFGAP1;
  Gene Name: ADP-ribosylation  factor GTPase activating prt 1;
  ENSP ID: ENSP00000429674
MKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSTESCFVAQAADWRAVVRPQLTATSASQVQGWSSFTTGASRFASAAKEGATKFGSQASQKASELGHSLNENVLKPAQEKVKEGKIFDDVSSGVSQLASKVQGVGSKGWRD

SEQ ID NO: 3234 - protein, 153 aa, Homo sapiens
  Payload ID: 721;
  Gene Symbol: ARFGAP1;
  Gene Name: ADP-ribosylation  factor GTPase activating prt 1;
  ENSP ID: ENSP00000429770
MASPRTRKVLKEVRVKEGKIFDDVSSGVSQLASKVQGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPT

SEQ ID NO: 3235 - protein, 361 aa, Homo sapiens
  Payload ID: 721;
  Gene Symbol: ARFGAP1;
  Gene Name: ADP-ribosylation  factor GTPase activating prt 1;
  Uniprot ID:  Q8N6T3;
  ENSP ID: ENSP00000430500
MRTTFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKFWGHKQQPEPASELGHSLNENVLKPAQEKVKEGKIFDDVSSGVSQLASKGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 3236 - protein, 261 aa, Homo sapiens
  Payload ID: 721;
  Gene Symbol: ARFGAP1;
  Gene Name: ADP-ribosylation  factor GTPase activating prt 1;
  ENSP ID: ENSP00000430929
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKASELGHSLNENVLKPAQEKVKE

SEQ ID NO: 3237 - protein, 293 aa, Homo sapiens
  Payload ID: 721;
  Gene Symbol: ARFGAP1;
  Gene Name: ADP-ribosylation  factor GTPase activating prt 1;
  Uniprot ID:  Q8N6T3;
  ENSP ID: ENSP00000443716
MLSSESSWSLRRITILAGPCRRSTTAEPRPSLGIRVSGQPQSVTASSDKAFEDWLNDDLGSYQGAQGNRYVGFGNTPPPQKKEDDFLNNAMSSLYSGWSSFTTGASRFASAAKEGATKFGSQASQKASELGHSLNENVLKPAQEKVKEGKIFDDVSSGVSQLASKVQGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 3238 - protein, 271 aa, Homo sapiens
  Payload ID: 721;
  Gene Symbol: ARFGAP1;
  Gene Name: ADP-ribosylation  factor GTPase activating prt 1;
  ENSP ID: ENSP00000447037
MKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKASELGHSLNENVLKPAQEKVKEGKIFDDVSSGVSQLASKVQGVGSKGWRDVTTFFSGKAEGPLDSPSEGHSYQNSGLDHFQNSNIDQSFWETFGSAEPTKTRKSPS

SEQ ID NO: 3239 - protein, 122 aa, Homo sapiens
  Payload ID: 721;
  Gene Symbol: ARFGAP1;
  Gene Name: ADP-ribosylation  factor GTPase activating prt 1;
  ENSP ID: ENSP00000449515
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGR

SEQ ID NO: 3240 - protein, 340 aa, Homo sapiens
  Payload ID: 721;
  Gene Symbol: ARFGAP1;
  Gene Name: ADP-ribosylation  factor GTPase activating prt 1;
  ENSP ID: ENSP00000449800
MKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKFWGHKQQPEPASELGHSLNENVLKPAQEKVKEGKIFDDVSSGVSQLASKGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 3241 - protein, 104 aa, Homo sapiens
  Payload ID: 721;
  Gene Symbol: ARFGAP1;
  Gene Name: ADP-ribosylation  factor GTPase activating prt 1;
  ENSP ID: ENSP00000449849
  MOD_RES (1)..(1): Any amino acid
XEPTKTRKSPSSDSWTCADTSTERRSSDSWEFFLFEESDWSGKDGNAGNDTGAHAAIRPPSAPESTPAWACAVRPASVVTLCGSPASAPSHHQVHQVHQTRPPQ

SEQ ID NO: 3242 - protein, 493 aa, Homo sapiens
  Payload ID: 722;
  Gene Symbol: ARFGAP2;
  Gene Name: ADP-ribosylation  factor GTPase activating prt 2;
  ENSP ID: ENSP00000400226
MAAEPNKTEIQTLFKRLRAVPTNKACFDCGAKNPSWASITYGVFLCIDCSGVHRSLGVHLSFIRSTELDSNWNWFQLRCMQVGGNANATAFFRQHGCTANDANTKYNSRAAQMYREKIRQLGSAALARHGTDPPAWDAPATEPSGTQQPAPSTESSGLAQPEHGPNTDLLGTSPKASLELKSSIIGKKKPAAAKKGLGAKKGLGAQKVSSQSFSEIERQAQVAEKLREQQAADAKKQAEESMVASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 3243 - protein, 16 aa, Homo sapiens
  Payload ID: 722;
  Gene Symbol: ARFGAP2;
  Gene Name: ADP-ribosylation  factor GTPase activating prt 2;
  ENSP ID: ENSP00000431238
KVREQGARGVSRPAGA

SEQ ID NO: 3244 - protein, 238 aa, Homo sapiens
  Payload ID: 722;
  Gene Symbol: ARFGAP2;
  Gene Name: ADP-ribosylation  factor GTPase activating prt 2;
  ENSP ID: ENSP00000431684
MAAEPNKTEIQTLFKRLRAVPTNKACFDCGAKNPSWASITYGVFLCIDCSGVHRSLGVHLSFIRSTELDSNWNWFQLRCMQVGGNANATAFFRQHGCTANDANTKYNSRAAQMYREKIRQLGSAALARHGTDLWIDNMSSAVPNHSPEKKDSDFFTEHTQVLVGLGASCQQEWLTEASVIWPPFQPPAWDAPATEPSGTQQPAPSTESSGLAQPEHGPNTDLLGTSPKASLELKSSII

SEQ ID NO: 3245 - protein, 17 aa, Homo sapiens
  Payload ID: 722;
  Gene Symbol: ARFGAP2;
  Gene Name: ADP-ribosylation  factor GTPase activating prt 2;
  ENSP ID: ENSP00000431847
NKVREQGARGVSRPAGA

SEQ ID NO: 3246 - protein, 327 aa, Homo sapiens
  Payload ID: 722;
  Gene Symbol: ARFGAP2;
  Gene Name: ADP-ribosylation  factor GTPase activating prt 2;
  ENSP ID: ENSP00000431939
MAAEPNKTEIQTLFKRLRAVPTNKACFDCGAKNPSWASITYGVFLCIDCSGVHRSLGVHLSFIRSTELDSNWNWFQLRCMQVGGNANATAFFRQHGCTANDANTKYNSRAAQMYREKIRQLGSAALARHGTDLWIDNMSSAVPNHSPEKKDSDFFTEHTQEWLTEASVIWPPFQPPAWDAPATEPSGTQQPAPSTESSGLAQPEHGPNTDLLGTSPKASLELKSSIIGKKKPAAAKKGLGAKKGLGAQKVSSQSFSEIERQAQVAEKLREQQAADAKKQAEESMVASMRLAYQELQIDRKKEEKKLQNLEGKKREQAERLGMGLVSR

SEQ ID NO: 3247 - protein, 89 aa, Homo sapiens
  Payload ID: 722;
  Gene Symbol: ARFGAP2;
  Gene Name: ADP-ribosylation  factor GTPase activating prt 2;
  ENSP ID: ENSP00000432978
MAAEPNKTEIQTLFKRLRAVPTNKACFDCGAKNPSWASITYGVFLCIDCSGVHRSLGVHLSFIRSTELDSNWNWFQLRCMQVGGNANAN

SEQ ID NO: 3248 - protein, 94 aa, Homo sapiens
  Payload ID: 722;
  Gene Symbol: ARFGAP2;
  Gene Name: ADP-ribosylation  factor GTPase activating prt 2;
  ENSP ID: ENSP00000433108
MAAEPNKTEIQTLFKRLRAVPTNKACFDCGAKNPSWASITYGVFLCIDCSGVHRSLGVHLSFIRSTELDSNWNWFQLRCMQVGGNANAIITSLS

SEQ ID NO: 3249 - protein, 70 aa, Homo sapiens
  Payload ID: 722;
  Gene Symbol: ARFGAP2;
  Gene Name: ADP-ribosylation  factor GTPase activating prt 2;
  ENSP ID: ENSP00000433210
MAAEPNKTEIQTLFKRLRAVPTNKACFDCGAKNPSWASITYGVFLCIDCSGVHRSLGVHLSFISWVPRKA

SEQ ID NO: 3250 - protein, 237 aa, Homo sapiens
  Payload ID: 722;
  Gene Symbol: ARFGAP2;
  Gene Name: ADP-ribosylation  factor GTPase activating prt 2;
  ENSP ID: ENSP00000434022
  MOD_RES (1)..(1): Any amino acid
XVASMRLAYQELQIDRKKEEKKLQNLEGKKREQAESSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQ

SEQ ID NO: 3251 - protein, 274 aa, Homo sapiens
  Payload ID: 722;
  Gene Symbol: ARFGAP2;
  Gene Name: ADP-ribosylation  factor GTPase activating prt 2;
  ENSP ID: ENSP00000434433
MAAEPNKTEIQTLFKRLRAVPTNKACFDCGAKNPSWASITYGVFLCIDCSGVHRSLGVHLSFIRSTELDSNWNWFQLRCMQVGGNANALGAKKGLGAQKVSSQSFSEIERQAQVAEKLREQQAADAKKQAEESMVASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVE

SEQ ID NO: 3252 - protein, 521 aa, Homo sapiens
  Payload ID: 722;
  Gene Symbol: ARFGAP2;
  Gene Name: ADP-ribosylation  factor GTPase activating prt 2;
  Uniprot ID:  Q8N6H7;
  ENSP ID: ENSP00000434442
MAAEPNKTEIQTLFKRLRAVPTNKACFDCGAKNPSWASITYGVFLCIDCSGVHRSLGVHLSFIRSTELDSNWNWFQLRCMQVGGNANATAFFRQHGCTANDANTKYNSRAAQMYREKIRQLGSAALARHGTDLWIDNMSSAVPNHSPEKKDSDFFTEHTQPPAWDAPATEPSGTQQPAPSTESSGLAQPEHGPNTDLLGTSPKASLELKSSIIGKKKPAAAKKGLGAKKGLGAQKVSSQSFSEIERQAQVAEKLREQQAADAKKQAEESMVASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 3253 - protein, 133 aa, Homo sapiens
  Payload ID: 722;
  Gene Symbol: ARFGAP2;
  Gene Name: ADP-ribosylation  factor GTPase activating prt 2;
  ENSP ID: ENSP00000434487
  MOD_RES (1)..(1): Any amino acid
XAAEPNKTEIQTLFKRLRAVPTNKACFDCGAKNPSWASITYGVFLCIDCSGVHRSLGVHLSFIRSTELDSNWNWFQLRCMQVGGNANATAFFRQHGCTANDANTKYNSRAAQMYREKIRQLGSAALARHGTDN

SEQ ID NO: 3254 - protein, 252 aa, Homo sapiens [sequence omitted]

SEQ ID NO: 3255 - protein, 173 aa, Homo sapiens
  Payload ID: 722;
  Gene Symbol: ARFGAP2;
  Gene Name: ADP-ribosylation  factor GTPase activating prt 2;
  ENSP ID: ENSP00000435488
MAAEPNKTEIQTLFKRLRAVPTNKACFDCGAKNPSWASITYGVFLCIDCSGVHRSLGVHLSFIRSTELDSNWNWFQLRCMQTAFFRQHGCTANDANTKYNSRAAQMYREKIRQLGSAALARHGTDLWIDNMSSAVPNHSPEKKDSDFFTEHTQPPAWDAPATEPSGTQQPAPS

SEQ ID NO: 3256 - protein, 110 aa, Homo sapiens
  Payload ID: 722;
  Gene Symbol: ARFGAP2;
  Gene Name: ADP-ribosylation  factor GTPase activating prt 2;
  ENSP ID: ENSP00000437070
MAAEPNKTEIQTLFKRLRAVPTNKACFDCGAKNPSWASITYGVFLCIDCSGVHRSLGVHLSFIRRLFFANMDAQPMMPTPNIIAELPRCTGRRSGSWGVRPWLGMALIFG

SEQ ID NO: 3257 - protein, 119 aa, Homo sapiens
  Payload ID: 722;
  Gene Symbol: ARFGAP2;
  Gene Name: ADP-ribosylation  factor GTPase activating prt 2;
  ENSP ID: ENSP00000437194
RSRTRPKSRLFLRGFAQFQPTRSTELDSNWNWFQLRCMQVGGNANATAFFRQHGCTANDANTKYNSRAAQMYREKIRQLGSAALARHGTDLWIDNMSSAVPNHSPEKKDSDFFTEHTQN

SEQ ID NO: 3258 - protein, 156 aa, Homo sapiens
  Payload ID: 722;
  Gene Symbol: ARFGAP2;
  Gene Name: ADP-ribosylation  factor GTPase activating prt 2;
  ENSP ID: ENSP00000437305
MAAEPNKTEIQTLFKRLRAVPTNKACFDCGAKNPSWASITYGVFLCIDCSGVHRSLGVHLSFIRYKDNPFSLGESFGSRWDTDAAWGMDRVEEKEPEVTISSIRPISERATNRREVESRSSGLESSEARQKFAGAKAISSDMFFGREVDAEYEARS

SEQ ID NO: 3259 - protein, 70 aa, Homo sapiens; identical to SEQ ID NO: 3249
  Payload ID: 722;
  Gene Symbol: ARFGAP2;
  Gene Name: ADP-ribosylation  factor GTPase activating prt 2;
  ENSP ID: ENSP00000486229

SEQ ID NO: 3260 - protein, 385 aa, Homo sapiens
  Payload ID: 722;
  Gene Symbol: ARFGAP2;
  Gene Name: ADP-ribosylation  factor GTPase activating prt 2;
  ENSP ID: ENSP00000486339
MAAEPNKTEIQTLFKRLRAVPTNKACFDCGAKNPSWASITYGVFLCIDCSGVHRSLGVHLSFIRSTELDSNWNWFQLRCMQVGGNANALGAKKGLGAQKVSSQSFSEIERQAQVAEKLREQQAADAKKQAEESMVASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 3261 - protein, 516 aa, Homo sapiens
  Payload ID: 723;
  Gene Symbol: ARFGAP3;
  Gene Name: ADP-ribosylation  factor GTPase activating prt 3;
  Uniprot ID:  Q9NP61;
  ENSP ID: ENSP00000263245
MGDPSKQDILTIFKRLRSVPTNKVCFDCGAKNPSWASITYGVFLCIDCSGSHRSLGVHLSFIRSTELDSNWSWFQLRCMQVGGNASASSFFHQHGCSTNDTNAKYNSRAAQLYREKIKSLASQATRKHGTDLWLDSCVVPPLSPPPKEEDFFASHVSPEVSDTAWASAIAEPSSLTSRPVETTLENNEGGQEQGPSVEGLNVPTKATLEVSSIIKKKPNQAKKGLGAKKGSLGAQKLANTCFNEIEKQAQAADKMKEQEDLAKVVSKEESIVSSLRLAYKDLEIQMKKDEKMNISGKKNVDSDRLGMGFGNCRSVISHSVTSDMQTIEQESPIMAKPRKKYNDDSDDSYFTSSSSYFDEPVELRSSSFSSWDDSSDSYWKKETSKDTETVLKTTGYSDRPTARRKPDYEPVENTDEAQKKFGNVKAISSDMYFGRQSQADYETRARLERLSASSSISSADLFEEPRKQPAGNYSLSSVLPNAPDMAQFKQGVRSVAGKLSVFANGVVTSIQDRYGS

SEQ ID NO: 3262 - protein, 472 aa, Homo sapiens
  Payload ID: 723;
  Gene Symbol: ARFGAP3;
  Gene Name: ADP-ribosylation  factor GTPase activating prt 3;
  Uniprot ID:  Q9NP61;
  ENSP ID: ENSP00000388791
MGDPSKQDILTIFKRLRSVPTNKVCFDCGAKNPSWASITYGVFLCIDCSGSHRSLGVHLSFIRSTELDSNWSWFQLRCMQVGGNASALWLDSCVVPPLSPPPKEEDFFASHVSPEVSDTAWASAIAEPSSLTSRPVETTLENNEGGQEQGPSVEGLNVPTKATLEVSSIIKKKPNQAKKGLGAKKGSLGAQKLANTCFNEIEKQAQAADKMKEQEDLAKVVSKEESIVSSLRLAYKDLEIQMKKDEKMNISGKKNVDSDRLGMGFGNCRSVISHSVTSDMQTIEQESPIMAKPRKKYNDDSDDSYFTSSSSYFDEPVELRSSSFSSWDDSSDSYWKKETSKDTETVLKTTGYSDRPTARRKPDYEPVENTDEAQKKFGNVKAISSDMYFGRQSQADYETRARLERLSASSSISSADLFEEPRKQPAGNYSLSSVLPNAPDMAQFKQGVRSVAGKLSVFANGVVTSIQDRYGS

SEQ ID NO: 3263 - protein, 152 aa, Homo sapiens
  Payload ID: 723;
  Gene Symbol: ARFGAP3;
  Gene Name: ADP-ribosylation  factor GTPase activating prt 3;
  ENSP ID: ENSP00000403520
MGDPSKQDILTIFKRLRSVPTNKVCFDCGAKNPSWASITYGVFLCIDCSGSHRSLGVHLSFIRSTELDSNWSWFQLRCMQVGGNASAVSDTAWASAIAEPSSLTSRPVETTLENNEGGQEQGPSVEGLNVPTKATLEVSSIIKKKPNQAKKG

SEQ ID NO: 3264 - protein, 273 aa, Homo sapiens
  Payload ID: 723;
  Gene Symbol: ARFGAP3;
  Gene Name: ADP-ribosylation  factor GTPase activating prt 3;
  ENSP ID: ENSP00000403995
  MOD_RES (1)..(1): Any amino acid
XLALFQVSDTAWASAIAEPSSLTSRPVETTLENNEGGQEQGPSVEGLNVPTKATLEVSSIIKKKPNQAKKGLGAKKGSLGAQKLANTCFNEIEKQAQAADKMKEQEDLAKVVSKEESIVSSLRLAYKDLEIQMKKDEKMNISGKKNVDSDRLGMGFGNCRSVISHSVTSDMQTIEQESPIMAKPRKKYNDDSDDSYFTSSSRPTARRKPDYEPVENTDEAQKKFGNVKAISSDMYFGRQSQADYETRARLERLSASSSISSADLFEEPRKQPA

SEQ ID NO: 3265 - protein, 92 aa, Homo sapiens
  Payload ID: 723;
  Gene Symbol: ARFGAP3;
  Gene Name: ADP-ribosylation  factor GTPase activating prt 3;
  ENSP ID: ENSP00000407734
MVCFDCGAKNPSWASITYGVFLCIDCSGSHRSLGVHLSFIRSTELDSNWSWFQLRCMQVGGNASASSFFHQHGCSTNDTNAKYNSRAAQLYR

SEQ ID NO: 3266 - protein, 1849 aa, Homo sapiens
  Payload ID: 724;
  Gene Symbol: ARFGEF1;
  Gene Name: ADP-ribosylation  factor guanine nucleotide-exchange factor 1 (brefeldin A-inhibited);
  Uniprot ID:  Q9Y6D6;
  ENSP ID: ENSP00000262215
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPDSTTPGKKLIDRIIETICGCFQGPQTDEGVQLQIIKALLTAVTSQHIEIHEGTVLQAVRTCYNIYLASKNLINQTTAKATLTQMLNVIFARMENQALQEAKQMEKERHRQHHHLLQSPVSHHEPESPQLRYLPPQTVDHISQEHEGDLDLHTNDVDKSLQDDTEPENGSDISSAENEQTEADQATAAETLSKNEVLYDGENHDCEEKPQDIVQNIVEEMVNIVVGDMGEGTTINASADGNIGTIEDGSDSENIQANGIPGTPISVAYTPSLPDDRLSVSSNDTQESGNSSGPSPGAKFSHILQKDAFLVFRSLCKLSMKPLSDGPPDPKSHELRSKILSLQLLLSILQNAGPIFRTNEMFINAIKQYLCVALSKNGVSSVPEVFELSLSIFLTLLSNFKTHLKMQIEVFFKEIFLYILETSTSSFDHKWMVIQTLTRICADAQSVVDIYVNYDCDLNAANIFERLVNDLSKIAQGRGSQELGMSNVQELSLRKKGLECLVSILKCMVEWSKDQYVNPNSQTTLGQEKPSEQEMSEIKHPETINRYGSLNSLESTSSSGIGSYSTQMSGTDNPEQFEVLKQQKEIIEQGIDLFNKKPKRGIQYLQEQGMLGTTPEDIAQFLHQEERLDSTQVGEFLGDNDKFNKEVMYAYVDQHDFSGKDFVSALRMFLEGFRLPGEAQKIDRLMEKFAARYLECNQGQTLFASADTAYVLAYSIIMLTTDLHSPQVKNKMTKEQYIKMNRGINDSKDLPEEYLSAIYNEIAGKKISMKETKELTIPTKSSKQNVASEKQRRLLYNLEMEQMAKTAKALMEAVSHVQAPFTSATHLEHVRPMFKLAWTPFLAAFSVGLQDCDDTEVASLCLEGIRCAIRIACIFSIQLERDAYVQALARFTLLTVSSGITEMKQKNIDTIKTLITVAHTDGNYLGNSWHEILKCISQLELAQLIGTGVKPRYISGTVRGREGSLTGTKDQAPDEFVGLGLVGGNVDWKQIASIQESIGETSSQSVVVAVDRIFTGSTRLDGNAIVDFVRWLCAVSMDELLSTTHPRMFSLQKIVEISYYNMGRIRLQWSRIWEVIGDHFNKVGCNPNEDVAIFAVDSLRQLSMKFLEKGELANFRFQKDFLRPFEHIMKRNRSPTIRDMVVRCIAQMVNSQAANIRSGWKNIFSVFHLAASDQDESIVELAFQTTGHIVTLVFEKHFPATIDSFQDAVKCLSEFACNAAFPDTSMEAIRLIRHCAKYVSDRPQAFKEYTSDDMNVAPEDRVWVRGWFPILFELSCIINRCKLDVRTRGLTVMFEIMKTYGHTYEKHWWQDLFRIVFRIFDNMKLPEQQTEKAEWMTTTCNHALYAICDVFTQYLEVLSDVLLDDIFAQLYWCVQQDNEQLARSGTNCLENVVILNGEKFTLEIWDKTCNCTLDIFKTTIPHALLTWRPNSGETAPPPPSPVSEKPLDTISQKSVDIHDSIQPRSVDNRPQAPLVSASAVNEEVSKIKSTAKFPEQKLFAALLIKCVVQLELIQTIDNIVFFPATSKKEDAENLAAAQRDAVDFDVRVDTQDQGMYRFLTSQQLFKLLDCLLESHRFAKAFNSNNEQRTALWKAGFKGKSKPNLLKQETSSLACGLRILFRMYMDESRVSAWEEVQQRLLNVCSEALSYFLTLTSESHREAWTNLLLLFLTKVLKISDNRFKAHASFYYPLLCEIMQFDLIPELRAVLRRFFLRIGVVFQISQPPEQELGINKQ

SEQ ID NO: 3267 - protein, 1279 aa, Homo sapiens
  Payload ID: 724;
  Gene Symbol: ARFGEF1;
  Gene Name: ADP-ribosylation  factor guanine nucleotide-exchange factor 1 (brefeldin A-inhibited);
  ENSP ID: ENSP00000428429
  MOD_RES (1)..(1): Any amino acid
XIEVFFKEIFLYILETSTSSFDHKWMVIQTLTRICADAQSVVDIYVNYDCDLNAANIFERLVNDLSKIAQGRGSQELGMSNVQELSLRKKGLECLVSILKCMVEWSKDQYVNPNSQTTLGQEKPSEQEMSEIKHPETINRYGSLNSLESTSSSGIGSYSTQMSGTDNPEQFEVLKQQKEIIEQGIDLFNKKPKRGIQYLQEQGMLGTTPEDIAQFLHQEERLDSTQVGEFLGDNDKFNKEVMYAYVDQHDFSGKDFVSALRMFLEGFRLPGEAQKIDRLMEKFAARYLECNQGQTLFASADTAYVLAYSIIMLTTDLHSPQVKNKMTKEQYIKMNRGINDSKDLPEEYLSAIYNEIAGKKISMKETKELTIPTKSSKQNVASEKQRRLLYNLEMEQMAKTAKALMEAVSHVQAPFTSATHLEHVRPMFKLAWTPFLAAFSVGLQDCDDTEVASLCLEGIRCAIRIACIFSIQLERDAYVQALARFTLLTVSSGITEMKQKNIDTIKTLITVAHTDGNYLGNSWHEILKCISQLELAQLIGTGVKPRYISGTVRGREGSLTGTKDQAPDEFVGLGLVGGNVDWKQIASIQESIGETSSQSVVVAVDRIFTGSTRLDGNAIVDFVRWLCAVSMDELLSTTHPRMFSLQKIVEISYYNMGRIRLQWSRIWEVIGDHFNKVGCNPNEDVAIFAVDSLRQLSMKFLEKGELANFRFQKDFLRPFEHIMKRNRSPTIRDMVVRCIAQMVNSQAANIRSGWKNIFSVFHLAASDQDESIVELAFQTTGHIVTLVFEKHFPATIDSFQDAVKCLSEFACNAAFPDTSMEAIRLIRHCAKYVSDRPQAFKEYTSDDMNVAPEDRVWVRGWFPILFELSCIINRCKLDVRTRGLTVMFEIMKTYGHTYEKHWWQDLFRIVFRIFDNMKLPEQQTEKAEWMTTTCNHALYAICDVFTQYLEVLSDVLLDDIFAQLYWCVQQDNEQLARSGTNCLENVVILNGEKFTLEIWDKTCNCTLDIFKTTIPHALLTWRPNSGETAPPPPSPVSEKPLDTISQKSVDIHDSIQPRSVDNRPQAPLVSASAVNEEVSKIKSTAKFPEQKLFAALLIKCVVQLELIQTIDNIVFFPATSKKEDAENLAAAQRDAVDFDVRVDTQDQGMYRFLTSQQLFKLLDCLLESHRFAKAFNSNNEQRTALWKAGFKGKSKPNLLKQETSSLACGLRILFRMYMDESRVSAWEEVQQRLLNVCSEALSYFLTLTSESHREAWTNLLLLFLTKVLKISDNRTKRTL

SEQ ID NO: 3268 - protein, 118 aa, Homo sapiens
  Payload ID: 724;
  Gene Symbol: ARFGEF1;
  Gene Name: ADP-ribosylation  factor guanine nucleotide-exchange factor 1 (brefeldin A-inhibited);
  ENSP ID: ENSP00000429002
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPD

SEQ ID NO: 3269 - protein, 192 aa, Homo sapiens
  Payload ID: 724;
  Gene Symbol: ARFGEF1;
  Gene Name: ADP-ribosylation  factor guanine nucleotide-exchange factor 1 (brefeldin A-inhibited);
  ENSP ID: ENSP00000429560
  MOD_RES (1)..(1): Any amino acid
XRLLLMKKSAKLNLQQLELIQTIDNIVFFPATSKKEDAENLAAAQRDAVDFDVRVDTQDQGMYRFLTSQQLFKLLDCLLESHRFAKAFNSNNEQRTALWKAGFKGKSKPNLLKQETSSLACGLRILFRMYMDESRVSAWEEVQQRLLNVCSEALSYFLTLTSESHREAWTNLLLLFLTKVLKISDNRTKRTL

SEQ ID NO: 3270 - protein, 825 aa, Homo sapiens
  Payload ID: 724;
  Gene Symbol: ARFGEF1;
  Gene Name: ADP-ribosylation  factor guanine nucleotide-exchange factor 1 (brefeldin A-inhibited);
  ENSP ID: ENSP00000430891
  MOD_RES (1)..(1): Any amino acid
XGNSWHEILKCISQLELAQLIGTGVKPRYISGTVRGREGSLTGTKDQAPDEFVGLGLVGGNVDWKQIASIQESIGETSSQSVVVAVDRIFTGSTRLDGNAIVDFVRWLCAVSMDELLSTTHPRMFSLQKIVEISYYNMGRIRLQWSRIWEVIGDHFNKVGCNPNEDVAIFAVDSLRQLSMKFLEKGELANFRFQKDFLRPFEHIMKRNRSPTIRDMVVRCIAQMVNSQAANIRSGWKNIFSVFHLAASDQDESIVELAFQTTGHIVTLVFEKHFPATIDSFQDAVKCLSEFACNAAFPDTSMEAIRLIRHCAKYVSDRPQAFKEYTSDDMNVAPEDRVWVRGWFPILFELSCIINRCKLDVRTRGLTVMFEIMKTYGHTYEKHWWQDLFRIVFRIFDNMKLPEQQTEKAEWMTTTCNHALYAICDVFTQYLEVLSDVLLDDIFAQLYWCVQQDNEQLARSGTNCLENVVILNGEKFTLEIWDKTCNCTLDIFKTTIPHALLTWRPNSGETAPPPPSPVSEKPLDTISQKSVDIHDSIQPRSVDNRPQAPLVSASAVNEEVSKIKSTAKFPEQKLFAALLIKCVVQLELIQTIDNIVFFPATSKKEDAENLAAAQRDAVDFDVRVDTQDQGMYRFLTSQQLFKLLDCLLESHRFAKAFNSNNEQRTALWKAGFKGKSKPNLLKQETSSLACGLRILFRMYMDESRVSAWEEVQQRLLNVCSEALSYFLTLTSESHREAWTNLLLLFLTKVLKISDNRVSMRLRIQPHISSPIRIGMRGPRAAVQELSEMNQAVPRLHCCLCKATSGLAVSSSVLAFLPPYPALFTN

SEQ ID NO: 3271 - protein, 1785 aa, Homo sapiens
  Payload ID: 725;
  Gene Symbol: ARFGEF2;
  Gene Name: ADP-ribosylation  factor guanine nucleotide-exchange factor 2 (brefeldin A-inhibited);
  Uniprot ID:  Q9Y6D5;
  ENSP ID: ENSP00000360985
MQESQTKSMFVSRALEKILADKEVKRPQHSQLRRACQVALDEIKAEIEKQRLGTAAPPKANFIEADKYFLPFELACQSKSPRVVSTSLDCLQKLIAYGHITGNAPDSGAPGKRLIDRIVETICSCFQGPQTDEGVQLQIIKALLTAVTSPHIEIHEGTILQTVRTCYNIYLASKNLINQTTAKATLTQMLNVIFTRMENQVLQEARELEKPIQSKPQSPVIQAAAVSPKFVRLKHSQAQSKPTTPEKTDLTNGEHARSDSGKVSTENGDAPRERGSSLSGTDDGAQEVVKDILEDVVTSAIKEAAEKHGLTEPERVLGELECQECAIPPGVDENSQTNGIADDRQSLSSADNLESDAQGHQVAARFSHVLQKDAFLVFRSLCKLSMKPLGEGPPDPKSHELRSKVVSLQLLLSVLQNAGPVFRTHEMFINAIKQYLCVALSKNGVSSVPDVFELSLAIFLTLLSNFKMHLKMQIEVFFKEIFLNILETSTSSFEHRWMVIQTLTRICADAQCVVDIYVNYDCDLNAANIFERLVNDLSKIAQGRSGHELGMTPLQELSLRKKGLECLVSILKCMVEWSKDLYVNPNHQTSLGQERLTDQEIGDGKGLDMARRCSVTSMESTVSSGTQTTVQDDPEQFEVIKQQKEIIEHGIELFNKKPKRGIQFLQEQGMLGTSVEDIAQFLHQEERLDSTQVGDFLGDSARFNKEVMYAYVDQLDFCEKEFVSALRTFLEGFRLPGEAQKIDRLMEKFAARYIECNQGQTLFASADTAYVLAYSIIMLTTDLHSPQVKNKMTKEQYIKMNRGINDSKDLPEEYLSSIYEEIEGKKIAMKETKELTIATKSTKQNVASEKQRRLLYNLEMEQMAKTAKALMEAVSHAKAPFTSATHLDHVRPMFKLVWTPLLAAYSIGLQNCDDTEVASLCLEGIRCAIRIACIFGMQLERDAYVQALARFSLLTASSSITEMKQKNIDTIKTLITVAHTDGNYLGNSWHEILKCISQLELAQLIGTGVKTRYLSGSGREREGSLKGHTLAGEEFMGLGLGNLVSGGVDKRQMASFQESVGETSSQSVVVAVDRIFTGSTRLDGNAIVDFVRWLCAVSMDELASPHHPRMFSLQKIVEISYYNMNRIRLQWSRIWHVIGDHFNKVGCNPNEDVAIFAVDSLRQLSMKFLEKGELANFRFQKDFLRPFEHIMKKNRSPTIRDMAIRCIAQMVNSQAANIRSGWKNIFAVFHQAASDHDGNIVELAFQTTCHIVTTIFQHHFPAAIDSFQDAVKCLSEFACNAAFPDTSMEAIRLIRFCGKYVSERPRVLQEYTSDDMNVAPGDRVWVRGWFPILFELSCIINRCKLDVRTRGLTVMFEIMKSYGHTFEKHWWQDLFRIVFRIFDNMKLPEQLSEKSEWMTTTCNHALYAICDVFTQFYEALNEVLLSDVFAQLQWCVKQDNEQLARSGTNCLENLVISNGEKFSPEVWDETCNCMLDIFKTTIPHVLLTWRPVGMEEDSSEKHLDVDLDRQSLSSIDKNPSERGQSQLSNPTDDSWKGRPYANQKLFASLLIKCVVQLELIQTIDNIVFYPATSKKEDAEHMVAAQQDTLDADIHIETEDQGMYKYMSSQHLFKLLDCLQESHSFSKAFNSNYEQRTVLWRAGFKGKSKPNLLKQETSSLACCLRILFRMYVDENRRDSWEEIQQRLLTVCSEALAYFITVNSESHREAWTSLLLLLLTKTLKINDEKFKAHASMYYPYLCEIMQFDLIPELRAVLRKFFLRIGVVYKIWIPEEPSQVPAALSPVW

SEQ ID NO: 3272 - protein, 373 aa, Homo sapiens
  Payload ID: 726;
  Gene Symbol: ARFIP1;
  Gene Name: ADP-ribosylation factor interacting prt 1;
  Uniprot ID:  P53367;
  ENSP ID: ENSP00000296557
MAQESPKNSAAEIPVTSNGEVDDSREHSFNRDLKHSLPSGLGLSETQITSHGFDNTKEGVIEAGAFQGSPAPPLPSVMSPSRVAASRLAQQGSDLIVPAGGQRTQTKSGPVILADEIKNPAMEKLELVRKWSLNTYKCTRQIISEKLGRGSRTVDLELEAQIDILRDNKKKYENILKLAQTLSTQLFQMVHTQRQLGDAFADLSLKSLELHEEFGYNADTQKLLAKNGETLLGAINFFIASVNTLVNKTIEDTLMTVKQYESARIEYDAYRTDLEELNLGPRDANTLPKIEQSQHLFQAHKEKYDKMRNDVSVKLKFLEENKVKVLHNQLVLFHNAIAAYFAGNQKQLEQTLKQFHIKLKTPGVDAPSWLEEQ

SEQ ID NO: 3273 - protein, 341 aa, Homo sapiens
  Payload ID: 726;
  Gene Symbol: ARFIP1;
  Gene Name: ADP-ribosylation factor interacting prt 1;
  Uniprot ID:  P53367;
  ENSP ID: ENSP00000348360
MAQESPKNSAAEIPVTSNGEVDDSREHSFNRDLKHSLPSGLGLSETQITSHGFDNTKEGVIEAGAFQGGQRTQTKSGPVILADEIKNPAMEKLELVRKWSLNTYKCTRQIISEKLGRGSRTVDLELEAQIDILRDNKKKYENILKLAQTLSTQLFQMVHTQRQLGDAFADLSLKSLELHEEFGYNADTQKLLAKNGETLLGAINFFIASVNTLVNKTIEDTLMTVKQYESARIEYDAYRTDLEELNLGPRDANTLPKIEQSQHLFQAHKEKYDKMRNDVSVKLKFLEENKVKVLHNQLVLFHNAIAAYFAGNQKQLEQTLKQFHIKLKTPGVDAPSWLEEQ

SEQ ID NO: 3274 - protein, 341 aa, Homo sapiens; identical to SEQ ID NO: 3273
  Payload ID: 726;
  Gene Symbol: ARFIP1;
  Gene Name: ADP-ribosylation factor interacting prt 1;
  Uniprot ID:  P53367;
  ENSP ID: ENSP00000384189

SEQ ID NO: 3275 - protein, 373 aa, Homo sapiens; identical to SEQ ID NO: 3272
  Payload ID: 726;
  Gene Symbol: ARFIP1;
  Gene Name: ADP-ribosylation factor interacting prt 1;
  Uniprot ID:  P53367;
  ENSP ID: ENSP00000395083

SEQ ID NO: 3276 - protein, 193 aa, Homo sapiens
  Payload ID: 726;
  Gene Symbol: ARFIP1;
  Gene Name: ADP-ribosylation factor interacting prt 1;
  Uniprot ID:  P53367;
  ENSP ID: ENSP00000396653
MAQESPKNSAAEIPVTSNGEVDDSREHSFNREEFGYNADTQKLLAKNGETLLGAINFFIASVNTLVNKTIEDTLMTVKQYESARIEYDAYRTDLEELNLGPRDANTLPKIEQSQHLFQAHKEKYDKMRNDVSVKLKFLEENKVKVLHNQLVLFHNAIAAYFAGNQKQLEQTLKQFHIKLKTPGVDAPSWLEEQ

SEQ ID NO: 3277 - protein, 341 aa, Homo sapiens; identical to SEQ ID NO: 3273
  Payload ID: 726;
  Gene Symbol: ARFIP1;
  Gene Name: ADP-ribosylation factor interacting prt 1;
  Uniprot ID:  P53367;
  ENSP ID: ENSP00000479111

SEQ ID NO: 3278 - protein, 341 aa, Homo sapiens
  Payload ID: 727;
  Gene Symbol: ARFIP2;
  Gene Name: ADP-ribosylation  factor interacting prt 2;
  Uniprot ID:  P53365;
  ENSP ID: ENSP00000254584
MTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 3279 - protein, 341 aa, Homo sapiens; identical to SEQ ID NO: 3278
  Payload ID: 727;
  Gene Symbol: ARFIP2;
  Gene Name: ADP-ribosylation  factor interacting prt 2;
  Uniprot ID:  P53365;
  ENSP ID: ENSP00000379998

SEQ ID NO: 3280 - protein, 256 aa, Homo sapiens
  Payload ID: 727;
  Gene Symbol: ARFIP2;
  Gene Name: ADP-ribosylation  factor interacting prt 2;
  Uniprot ID:  P53365;
  ENSP ID: ENSP00000391427
MKPALCLVAMGALVMDSSPQCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 3281 - protein, 303 aa, Homo sapiens
  Payload ID: 727;
  Gene Symbol: ARFIP2;
  Gene Name: ADP-ribosylation  factor interacting prt 2;
  Uniprot ID:  P53365;
  ENSP ID: ENSP00000398375
MVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 3282 - protein, 202 aa, Homo sapiens
  Payload ID: 727;
  Gene Symbol: ARFIP2;
  Gene Name: ADP-ribosylation  factor interacting prt 2;
  ENSP ID: ENSP00000434124
MTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQPTGRTPSGWAQPYPQQHSPVEAA

SEQ ID NO: 3283 - protein, 159 aa, Homo sapiens
  Payload ID: 727;
  Gene Symbol: ARFIP2;
  Gene Name: ADP-ribosylation  factor interacting prt 2;
  ENSP ID: ENSP00000434564
MTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKRNLATMQRHRNYYARMGKRC

SEQ ID NO: 3284 - protein, 374 aa, Homo sapiens
  Payload ID: 727;
  Gene Symbol: ARFIP2;
  Gene Name: ADP-ribosylation  factor interacting prt 2;
  ENSP ID: ENSP00000484121
MTDGILGKAATMEIPIHGNGEARQLPEDDGLEQDLQQVMVSGPNLNETSIVSGGYGGSGDGLIPTGKSISCARREVWVGPQRCLVYLREAGVRELDPLGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 3285 - protein, 154 aa, Homo sapiens
  Payload ID: 728;
  Gene Symbol: ARFRP1;
  Gene Name: ADP-ribosylation  factor related prt 1;
  Uniprot ID:  Q13795;
  ENSP ID: ENSP00000476756
MSLSKITTTVGLNIGTVDVGKARLMFWDLGGQEELQSLWDKYYAECHGVIYVIDSTDEERLAESKQAFEKVVTSEALCGVPVLVLANKQDVETCLSIPDIKTAFSDCTSKIGRRDCLTQACSALTGKGVREGIEWMVKCVVRNVHRPPRQRDIT

SEQ ID NO: 3286 - protein, 173 aa, Homo sapiens
  Payload ID: 728;
  Gene Symbol: ARFRP1;
  Gene Name: ADP-ribosylation  factor related prt 1;
  Uniprot ID:  Q13795;
  ENSP ID: ENSP00000479058
MYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFEKVVTSEALCGVPVLVLANKQDVETCLSIPDIKTAFSDCTSKIGRRDCLTQACSALTG

SEQ ID NO: 3287 - protein, 201 aa, Homo sapiens
  Payload ID: 728;
  Gene Symbol: ARFRP1;
  Gene Name: ADP-ribosylation  factor related prt 1;
  Uniprot ID:  Q13795;
  ENSP ID: ENSP00000479616
MYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFEKVVTSEALCGVPVLVLANKQDVETCLSIPDIKTAFSDCTSKIGRRDCLTQACSALTGKGVREGIEWMVKCVVRNVHRPPRQRDIT

SEQ ID NO: 3288 - protein, 201 aa, Homo sapiens; identical to SEQ ID NO: 3287
  Payload ID: 728;
  Gene Symbol: ARFRP1;
  Gene Name: ADP-ribosylation  factor related prt 1;
  Uniprot ID:  Q13795;
  ENSP ID: ENSP00000479940

SEQ ID NO: 3289 - protein, 121 aa, Homo sapiens
  Payload ID: 728;
  Gene Symbol: ARFRP1;
  Gene Name: ADP-ribosylation  factor related prt 1;
  Uniprot ID:  Q13795;
  ENSP ID: ENSP00000481446
MYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFDVPLNP

SEQ ID NO: 3290 - protein, 121 aa, Homo sapiens; identical to SEQ ID NO: 3289
  Payload ID: 728;
  Gene Symbol: ARFRP1;
  Gene Name: ADP-ribosylation  factor related prt 1;
  Uniprot ID:  Q13795;
  ENSP ID: ENSP00000483130

SEQ ID NO: 3291 - protein, 201 aa, Homo sapiens; identical to SEQ ID NO: 3287
  Payload ID: 728;
  Gene Symbol: ARFRP1;
  Gene Name: ADP-ribosylation  factor related prt 1;
  Uniprot ID:  Q13795;
  ENSP ID: ENSP00000483486

SEQ ID NO: 3292 - protein, 154 aa, Homo sapiens; identical to SEQ ID NO: 3285
  Payload ID: 728;
  Gene Symbol: ARFRP1;
  Gene Name: ADP-ribosylation  factor related prt 1;
  Uniprot ID:  Q13795;
  ENSP ID: ENSP00000484109

SEQ ID NO: 3293 - protein, 181 aa, Homo sapiens
  Payload ID: 729;
  Gene Symbol: ARL1;
  Gene Name: ADP-ribosylation factor-like 1;
  Uniprot ID:  P40616;
  ENSP ID: ENSP00000261636
MGGFFSSIFSSLFGTREMRILILGLDGAGKTTILYRLQVGEVVTTIPTIGFNVETVTYKNLKFQVWDLGGQTSIRPYWRCYYSNTDAVIYVVDSCDRDRIGISKSELVAMLEEEELRKAILVVFANKQDMEQAMTSSEMANSLGLPALKDRKWQIFKTSATKGTGLDEAMEWLVETLKSRQ

SEQ ID NO: 3294 - protein, 135 aa, Homo sapiens
  Payload ID: 729;
  Gene Symbol: ARL1;
  Gene Name: ADP-ribosylation factor-like 1;
  ENSP ID: ENSP00000439590
MAIGFNVETVTYKNLKFQVWDLGGQTSIRPYWRCYYSNTDAVIYVVDSCDRDRIGISKSELVAMLEEEELRKAILVVFANKQDMEQAMTSSEMANSLGLPALKDRKWQIFKTSATKGTGLDEAMEWLVETLKSRQ

SEQ ID NO: 3295 - protein, 164 aa, Homo sapiens
  Payload ID: 729;
  Gene Symbol: ARL1;
  Gene Name: ADP-ribosylation factor-like 1;
  Uniprot ID:  P40616;
  ENSP ID: ENSP00000441808
MRILILGLDGAGKTTILYRLQVGEVVTTIPTIGFNVETVTYKNLKFQVWDLGGQTSIRPYWRCYYSNTDAVIYVVDSCDRDRIGISKSELVAMLEEEELRKAILVVFANKQDMEQAMTSSEMANSLGLPALKDRKWQIFKTSATKGTGLDEAMEWLVETLKSRQ

SEQ ID NO: 3296 - protein, 52 aa, Homo sapiens
  Payload ID: 729;
  Gene Symbol: ARL1;
  Gene Name: ADP-ribosylation factor-like 1;
  ENSP ID: ENSP00000447405
MEQAMTSSEMANSLGLPALKDRKWQIFKTSATKGTGLDEAMEWLVETLKSRQ

SEQ ID NO: 3297 - protein, 164 aa, Homo sapiens; identical to SEQ ID NO: 3295
  Payload ID: 729;
  Gene Symbol: ARL1;
  Gene Name: ADP-ribosylation factor-like 1;
  Uniprot ID:  P40616;
  ENSP ID: ENSP00000448850

SEQ ID NO: 3298 - protein, 194 aa, Homo sapiens
  Payload ID: 729;
  Gene Symbol: ARL1;
  Gene Name: ADP-ribosylation factor-like 1;
  ENSP ID: ENSP00000448912
MGGFFSSIFSSLFGTREMRILILGLDGAGKTTILYRLQVGEVVTTIPTIGFNVETVTYKNLKFQVWDLGGQTSIRPYWRCYYSNTDAVIYVVDSCDRDRIGISKSELVAMLEEEELRKAILVVFANKQDMEQAMTSSEMANSLGLPALKDRKWQIFKTSATKGTGLDEAMEWQVSCFQKPSVHLCVLAAMHVHV

SEQ ID NO: 3299 - protein, 64 aa, Homo sapiens
  Payload ID: 729;
  Gene Symbol: ARL1;
  Gene Name: ADP-ribosylation factor-like 1;
  ENSP ID: ENSP00000450162
MGGFFSSIFSSLFGTREMRILILGLDGAGKTTILYRLQVGEVVTTIPKLLAFKKYPEDGIDLAN

SEQ ID NO: 3300 - protein, 17 aa, Homo sapiens
  Payload ID: 729;
  Gene Symbol: ARL1;
  Gene Name: ADP-ribosylation factor-like 1;
  ENSP ID: ENSP00000450315
MRILILGLDGAGKTTIL

SEQ ID NO: 3301 - protein, 244 aa, Homo sapiens
  Payload ID: 730;
  Gene Symbol: ARL10;
  Gene Name: ADP-ribosylation factor-like 10;
  Uniprot ID:  Q8N8L6;
  ENSP ID: ENSP00000308496
MAPRPLGPLVLALGGAAAVLGSVLFILWKTYFGRGRERRWDRGEAWWGAEAARLPEWDEWDPEDEEDEEPALEELEQREVLVLGLDGAGKSTFLRVLSGKPPLEGHIPTWGFNSVRLPTKDFEVDLLEIGGSQNLRFYWKEFVSEVDVLVFVVDSADRLRLPWARQELHKLLDKDPDLPVVVVANKQDLSEAMSMGELQRELGLQAIDNQREVFLLAASIAPAGPTFEEPGTVHIWKLLLELLS

SEQ ID NO: 3302 - protein, 48 aa, Homo sapiens
  Payload ID: 730;
  Gene Symbol: ARL10;
  Gene Name: ADP-ribosylation factor-like 10;
  ENSP ID: ENSP00000421449
  MOD_RES (1)..(1): Any amino acid
XSEVDVLVFVVDSADRLRLPWARQELHKLLDKDPDLPVVVVANKQMLK

SEQ ID NO: 3303 - protein, 79 aa, Homo sapiens
  Payload ID: 730;
  Gene Symbol: ARL10;
  Gene Name: ADP-ribosylation factor-like 10;
  ENSP ID: ENSP00000424831
PDLPVVVVANKQVLPYRFSVVPGMSDVGATGKERHRGSVISRTVPAEAHGHPEPQPPHHSIRGAAFRRAFRFRRFRLTL

SEQ ID NO: 3304 - protein, 196 aa, Homo sapiens
  Payload ID: 731;
  Gene Symbol: ARL11;
  Gene Name: ADP-ribosylation factor-like 11;
  Uniprot ID:  Q969Q4;
  ENSP ID: ENSP00000282026
MGSVNSRGHKAEAQVVMMGLDSAGKTTLLYKLKGHQLVETLPTVGFNVEPLKAPGHVSLTLWDVGGQAPLRASWKDYLEGTDILVYVLDSTDEARLPESAAELTEVLNDPNMAGVPFLVLANKQEAPDALPLLKIRNRLSLERFQDHCWELRGCSALTGEGLPEALQSLWSLLKSRSCMCLQARAHGAERGDSKRS

SEQ ID NO: 3305 - protein, 163 aa, Homo sapiens
  Payload ID: 732;
  Gene Symbol: ARL13A;
  Gene Name: ADP-ribosylation factor-like 13A;
  ENSP ID: ENSP00000362044
  MOD_RES (1)..(1): Any amino acid
XLANKQDKKKALMPCDIIDYLLLKKLVKENKCPCRVEPCSAIRNLERRNHQPIVEGLRWLLAVIDTCQLPPTSSISISKNNTGSGERCSSHSFSTRTGMSKEKRQHLEQCSIEAKPLKSILQKEAIKSILYSLRGSRRVRWHPLRMKTTLVKKNRDFTSLYRD

SEQ ID NO: 3306 - protein, 256 aa, Homo sapiens
  Payload ID: 732;
  Gene Symbol: ARL13A;
  Gene Name: ADP-ribosylation factor-like 13A;
  Uniprot ID:  Q5H913;
  ENSP ID: ENSP00000398637
MFRLLSSCCSCLRTTEETRRNVTIPIIGLNNSGKTVLVEAFQKLLPSKTDHCMKSELTTLLLDEYELSIYDLNGDLKGREAWPNYYAQAHGLVFVLDSSDIRRMQEVKIILTHLLSDKRVAGKPILILANKQDKKKALMPCDIIDYLLLKKLVKENKCPCRVEPCSAIRNLERRNHQPIVEGLRWLLAVIDTCQLPPTSSISISKNNTGSGERCSSHSFSTRTGMSKEKRQHLEQCSIEAKPLKSILQPSNQSYTH

SEQ ID NO: 3307 - protein, 290 aa, Homo sapiens
  Payload ID: 732;
  Gene Symbol: ARL13A;
  Gene Name: ADP-ribosylation factor-like 13A;
  Uniprot ID:  Q5H913;
  ENSP ID: ENSP00000414757
MFRLLSSCCSCLRTTEETRRNVTIPIIGLNNSGKTVLVEAFQKLLPSKTDHCMKSELTTLLLDEYELSIYDLNGDLKGREAWPNYYAQAHGLVFVLDSSDIRRMQEVKIILTHLLSDKRVAGKPILILANKQDKKKALMPCDIIDYLLLKKLVKENKCPCRVEPCSAIRNLERRNHQPIVEGLRWLLAVIDTCQLPPTSSISISKNNTGSGERCSSHSFSTRTGMSKEKRQHLEQCSIEAKPLKSILQKEGTRLWSKKNMSVTFALDEPMKEGECSRRMRAQNTTKLCYN

SEQ ID NO: 3308 - protein, 124 aa, Homo sapiens
  Payload ID: 732;
  Gene Symbol: ARL13A;
  Gene Name: ADP-ribosylation factor-like 13A;
  ENSP ID: ENSP00000445825
  MOD_RES (1)..(1): Any amino acid
XIRNLERRNHQPIVEGLRWLLAVIDTCQLPPTSSISISKNNTGSGERCSSHSFSTRTGMSKEKRQHLEQCSIEAKPLKSILQKEGTRLWSKKNMSVTFALDEPMKEGECSRRMRAQNTTKLCYN

SEQ ID NO: 3309 - protein, 321 aa, Homo sapiens
  Payload ID: 733;
  Gene Symbol: ARL13B;
  Gene Name: ADP-ribosylation factor-like 13B;
  Uniprot ID:  Q3SXY8;
  ENSP ID: ENSP00000306225
MFSLMASCCGWFKRWREPVRLANKQDKEGALGEADVIECLSLEKLVNEHKCLCQIEPCSAISGYGKKIDKSIKKGLYWLLHVIARDFDALNERIQKETTEQRALEEQEKQERAERVRKLREERKQNEQEQAELDGTSGLAELDPEPTNPFQPIASVIIENEGKLEREKKNQKMEKDSDGCHLKHKMEHEQIETQGQVNHNGQKNNEFGLVENYKEALTQQLKNEDETDRPSLESANGKKKTKKLRMKRNHRVEPLNIDDCAPESPTPPPPPPPVGWGTPKVTRLPKLEPLGETHHNDFYRKPLPPLAVPQRPNSDAHDVIS

SEQ ID NO: 3310 - protein, 89 aa, Homo sapiens
  Payload ID: 733;
  Gene Symbol: ARL13B;
  Gene Name: ADP-ribosylation factor-like 13B;
  ENSP ID: ENSP00000335400
MFSLMASCCGWFKRWREPVRKVTLLMVGLDNAGKTATAKGIQGEMGSPYVAQAGLECLASSYSSALASKSAGITGMSHHAQPGQNTLKM

SEQ ID NO: 3311 - protein, 428 aa, Homo sapiens
  Payload ID: 733;
  Gene Symbol: ARL13B;
  Gene Name: ADP-ribosylation factor-like 13B;
  Uniprot ID:  Q3SXY8;
  ENSP ID: ENSP00000377769
MFSLMASCCGWFKRWREPVRKVTLLMVGLDNAGKTATAKGIQGEYPEDVAPTVGFSKINLRQGKFEVTIFDLGGGIRIRGIWKNYYAESYGVIFVVDSSDEERMEETKEAMSEMLRHPRISGKPILVLANKQDKEGALGEADVIECLSLEKLVNEHKCLCQIEPCSAISGYGKKIDKSIKKGLYWLLHVIARDFDALNERIQKETTEQRALEEQEKQERAERVRKLREERKQNEQEQAELDGTSGLAELDPEPTNPFQPIASVIIENEGKLEREKKNQKMEKDSDGCHLKHKMEHEQIETQGQVNHNGQKNNEFGLVENYKEALTQQLKNEDETDRPSLESANGKKKTKKLRMKRNHRVEPLNIDDCAPESPTPPPPPPPVGWGTPKVTRLPKLEPLGETHHNDFYRKPLPPLAVPQRPNSDAHDVIS

SEQ ID NO: 3312 - protein, 56 aa, Homo sapiens
  Payload ID: 733;
  Gene Symbol: ARL13B;
  Gene Name: ADP-ribosylation factor-like 13B;
  ENSP ID: ENSP00000417263
MFSLMASCCGWFKRWREPVRKVTLLMVGLDNAGKTATAKGIQGGTMFSNLGVWKEN

SEQ ID NO: 3313 - protein, 428 aa, Homo sapiens; identical to SEQ ID NO: 3311
  Payload ID: 733;
  Gene Symbol: ARL13B;
  Gene Name: ADP-ribosylation factor-like 13B;
  Uniprot ID:  Q3SXY8;
  ENSP ID: ENSP00000420780

SEQ ID NO: 3314 - protein, 325 aa, Homo sapiens
  Payload ID: 733;
  Gene Symbol: ARL13B;
  Gene Name: ADP-ribosylation factor-like 13B;
  Uniprot ID:  Q3SXY8;
  ENSP ID: ENSP00000445145
MEETKEAMSEMLRHPRISGKPILVLANKQDKEGALGEADVIECLSLEKLVNEHKCLCQIEPCSAISGYGKKIDKSIKKGLYWLLHVIARDFDALNERIQKETTEQRALEEQEKQERAERVRKLREERKQNEQEQAELDGTSGLAELDPEPTNPFQPIASVIIENEGKLEREKKNQKMEKDSDGCHLKHKMEHEQIETQGQVNHNGQKNNEFGLVENYKEALTQQLKNEDETDRPSLESANGKKKTKKLRMKRNHRVEPLNIDDCAPESPTPPPPPPPVGWGTPKVTRLPKLEPLGETHHNDFYRKPLPPLAVPQRPNSDAHDVIS

SEQ ID NO: 3315 - protein, 192 aa, Homo sapiens
  Payload ID: 734;
  Gene Symbol: ARL14;
  Gene Name: ADP-ribosylation factor-like 14;
  Uniprot ID:  Q8N4G2;
  ENSP ID: ENSP00000323847
MGSLGSKNPQTKQAQVLLLGLDSAGKSTLLYKLKLAKDITTIPTIGFNVEMIELERNLSLTVWDVGGQEKMRTVWGCYCENTDGLVYVVDSTDKQRLEESQRQFEHILKNEHIKNVPVVLLANKQDMPGALTAEDITRMFKVKKLCSDRNWYVQPCCALTGEGLAQGFRKLTGFVKSHMKSRGDTLAFFKQN

SEQ ID NO: 3316 - protein, 260 aa, Homo sapiens
  Payload ID: 735;
  Gene Symbol: ARL14EP;
  Gene Name: ADP-ribosylation factor-like 14 effector prt;
  Uniprot ID:  Q8N8R7;
  ENSP ID: ENSP00000282032
MMDPCSVGVQLRTTNECHKTYYTRHTGFKTLQELSSNDMLLLQLRTGMTLSGNNTICFHHVKIYIDRFEDLQKSCCDPFNIHKKLAKKNLHVIDLDDATFLSAKFGRQLVPGWKLCPKCTQIINGSVDVDTEDRQKRKPESDGRTAKALRSLQFTNPGRQTEFAPETGKREKRRLTKNATAGSDRQVIPAKSKVYDSQGLLIFSGMDLCDCLDEDCLGCFYACPACGSTKCGAECRCDRKWLYEQIEIEGGEIIHNKHAG

SEQ ID NO: 3317 - protein, 168 aa, Homo sapiens
  Payload ID: 735;
  Gene Symbol: ARL14EP;
  Gene Name: ADP-ribosylation factor-like 14 effector prt;
  ENSP ID: ENSP00000432224
MMDPCSVGVQLRTTNECHKTYYTRHTGFKTLQELSSNDMLLLQLRTGMTLSGNNTICFHHVKIYIDRFEDLQKSCCDPFNIHKKLAKKNLHVIDLDDATFLSAKFGRQLVPGWKLCPKCTQIINGSVDVDTEDRQKRKPESDGRTAKALRSLQFTNPGRQTEFAPETG

SEQ ID NO: 3318 - protein, 152 aa, Homo sapiens
  Payload ID: 736;
  Gene Symbol: ARL14EPL;
  Gene Name: ADP-ribosylation factor-like 14 effector prt-like;
  Uniprot ID:  P0DKL9;
  ENSP ID: ENSP00000472409
MNEQSEKNNSIQERHTDHSFPEKNCQIGQKQLQQIERQLKCLAFRNPGPQVADFNPETRQQKKKARMSKMNEYFSTKYKIMRKYDKSGRLICNDADLCDCLEKNCLGCFYPCPKCNSNKCGPECRCNRRWVYDAIVTESGEVISTLPFNVPD

SEQ ID NO: 3319 - protein, 152 aa, Homo sapiens; identical to SEQ ID NO: 3318
  Payload ID: 736;
  Gene Symbol: ARL14EPL;
  Gene Name: ADP-ribosylation factor-like 14 effector prt-like;
  ENSP ID: ENSP00000489287

SEQ ID NO: 3320 - protein, 158 aa, Homo sapiens
  Payload ID: 737;
  Gene Symbol: ARL15;
  Gene Name: ADP-ribosylation factor-like 15;
  ENSP ID: ENSP00000432680
MSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEDDLEAARNELHSALQHPQLCTLPFLILANHQDKPAARSVQEKIQD

SEQ ID NO: 3321 - protein, 204 aa, Homo sapiens
  Payload ID: 737;
  Gene Symbol: ARL15;
  Gene Name: ADP-ribosylation factor-like 15;
  Uniprot ID:  Q9NXU5;
  ENSP ID: ENSP00000433427
MSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEDDLEAARNELHSALQHPQLCTLPFLILANHQDKPAARSVQEIKKYFELEPLARGKRWILQPCSLDDMDALKDSFSQLINLLEEKDHEAVRM

SEQ ID NO: 3322 - protein, 25 aa, Homo sapiens
  Payload ID: 737;
  Gene Symbol: ARL15;
  Gene Name: ADP-ribosylation factor-like 15;
  ENSP ID: ENSP00000473508
MDALKDSFSQLINLLEEKDHEAVRM

SEQ ID NO: 3323 - protein, 204 aa, Homo sapiens [sequence omitted]

SEQ ID NO: 3324 - protein, 197 aa, Homo sapiens
  Payload ID: 738;
  Gene Symbol: ARL16;
  Gene Name: ADP-ribosylation factor-like 16;
  Uniprot ID:  Q0P5N6;
  ENSP ID: ENSP00000380635
MRVAGGRALSRGAELRVPGGAKHGMCLLLGATGVGKTLLVKRLQEVSSRDGKGDLGEPPPTRPTVGTNLTDIVAQRKITIRELGGCMGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 3325 - protein, 93 aa, Homo sapiens
  Payload ID: 738;
  Gene Symbol: ARL16;
  Gene Name: ADP-ribosylation factor-like 16;
  ENSP ID: ENSP00000458672
MDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 3326 - protein, 93 aa, Homo sapiens; identical to SEQ ID NO: 3325
  Payload ID: 738;
  Gene Symbol: ARL16;
  Gene Name: ADP-ribosylation factor-like 16;
  ENSP ID: ENSP00000458980

SEQ ID NO: 3327 - protein, 111 aa, Homo sapiens
  Payload ID: 738;
  Gene Symbol: ARL16;
  Gene Name: ADP-ribosylation factor-like 16;
  ENSP ID: ENSP00000459201
MGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 3328 - protein, 93 aa, Homo sapiens; identical to SEQ ID NO: 3325
  Payload ID: 738;
  Gene Symbol: ARL16;
  Gene Name: ADP-ribosylation factor-like 16;
  ENSP ID: ENSP00000460198

SEQ ID NO: 3329 - protein, 48 aa, Homo sapiens
  Payload ID: 738;
  Gene Symbol: ARL16;
  Gene Name: ADP-ribosylation factor-like 16;
  ENSP ID: ENSP00000461661
VGTNLTDIVAQRKITIRELGGCMGPIWSSYYGNCRSLLACAADTSMEN

SEQ ID NO: 3330 - protein, 111 aa, Homo sapiens; identical to SEQ ID NO: 3327
  Payload ID: 738;
  Gene Symbol: ARL16;
  Gene Name: ADP-ribosylation factor-like 16;
  ENSP ID: ENSP00000461674

SEQ ID NO: 3331 - protein, 197 aa, Homo sapiens; identical to SEQ ID NO: 3324
  Payload ID: 738;
  Gene Symbol: ARL16;
  Gene Name: ADP-ribosylation factor-like 16;
  Uniprot ID:  Q0P5N6;
  ENSP ID: ENSP00000480579

SEQ ID NO: 3332 - protein, 173 aa, Homo sapiens
  Payload ID: 738;
  Gene Symbol: ARL16;
  Gene Name: ADP-ribosylation factor-like 16;
  ENSP ID: ENSP00000483183
MCLLLGATGVGKTLLVKRLQEVSSRDGKGDLGEPPPTRPTVGTNLTDIVAQRKITIRELGGCMGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 3333 - protein, 141 aa, Homo sapiens
  Payload ID: 739;
  Gene Symbol: ARL17A;
  Gene Name: ADP-ribosylation factor-like 17A;
  ENSP ID: ENSP00000331563
MGNIFEKLFKSLLGKKKMRILILSLDTAGKTTILYKLKLGETVPAVPTVGFCVETVEYKNNTFAVWDVGSHFKIRPLWQHFFQNTKGSCSIDQAGVQWRDLGSLQRPLPKLRFVSHTSPHTKLLHTRPRTASRKCFFRGKI

SEQ ID NO: 3334 - protein, 177 aa, Homo sapiens
  Payload ID: 739;
  Gene Symbol: ARL17A;
  Gene Name: ADP-ribosylation factor-like 17A;
  Uniprot ID:  Q8IVW1;
  ENSP ID: ENSP00000337478
MGNIFEKLFKSLLGKKKMRILILSLDTAGKTTILYKLKLGETVPAVPTVGFCVETVEYKNNTFAVWDVGSHFKIRPLWQHFFQNTKGARSPGSTHQGSLASGVLPIKCSHVEFGMWKGGRSHPFLPHSSRCAGSGGQLDSILPHQSPAWGPWGCKDLSSGFPSFLTSSILWKSAVVK

SEQ ID NO: 3335 - protein, 125 aa, Homo sapiens
  Payload ID: 739;
  Gene Symbol: ARL17A;
  Gene Name: ADP-ribosylation factor-like 17A;
  Uniprot ID:  Q8IVW1;
  ENSP ID: ENSP00000416535
MGNIFEKLFKSLLGKKKMRILILSLDTAGKTTILYKLKLGETVPAVPTVGFCVETVEYKNNTFAVWDVGSHFKIRPLWQHFFQNTKELSASQFAQFIKKLCGVTGTNDEASPGSLTSYPSHLLDR

SEQ ID NO: 3336 - protein, 87 aa, Homo sapiens
  Payload ID: 739;
  Gene Symbol: ARL17A;
  Gene Name: ADP-ribosylation factor-like 17A;
  ENSP ID: ENSP00000459606
MGNIFEKLFKSLLGKKKMRILILSLDTAGKTTILYKLKLGETVPAVPTVGFCVETVEYKNNTFAVWDVGSHFKIRPLWQHFFQNTKA

SEQ ID NO: 3337 - protein, 95 aa, Homo sapiens
  Payload ID: 739;
  Gene Symbol: ARL17A;
  Gene Name: ADP-ribosylation factor-like 17A;
  ENSP ID: ENSP00000459759
MGNIFEKLFKSLLGKKKMRILILSLDTAGKTTILYKLKLGETVPAVPTVGFCVETVEYKNNTFAVWDVGSHFKIRPLWQHFFQNTKAAHSQSLTS

SEQ ID NO: 3338 - protein, 88 aa, Homo sapiens
  Payload ID: 739;
  Gene Symbol: ARL17A;
  Gene Name: ADP-ribosylation factor-like 17A;
  ENSP ID: ENSP00000481578
MGNIFEKLFKSLLGKKKMRILILSLDTAGKTTILYKLKLGETVPAVPTVGFCVETVEYKNNTFAVWDVGSHFKIRPLWQHFFQNTKGS

SEQ ID NO: 3339 - protein, 125 aa, Homo sapiens; identical to SEQ ID NO: 3335
  Payload ID: 740;
  Gene Symbol: ARL17B;
  Gene Name: ADP-ribosylation factor-like 17B;
  Uniprot ID:  Q8IVW1;
  ENSP ID: ENSP00000391751

SEQ ID NO: 3340 - protein, 177 aa, Homo sapiens; identical to SEQ ID NO: 3334
  Payload ID: 740;
  Gene Symbol: ARL17B;
  Gene Name: ADP-ribosylation factor-like 17B;
  Uniprot ID:  Q8IVW1;
  ENSP ID: ENSP00000404247

SEQ ID NO: 3341 - protein, 111 aa, Homo sapiens
  Payload ID: 740;
  Gene Symbol: ARL17B;
  Gene Name: ADP-ribosylation factor-like 17B;
  ENSP ID: ENSP00000458681
  MOD_RES (1)..(1): Any amino acid
XDVGSHFKIRPLWQHFFQNTKGARSPGSTHQGSLASGVLPIKCSHVEFGMWKGGRSHPFLPHSSRCAGSGGQLDSILPHQSPAWGPWGCKDLSSGFPSFLTSSILWKSAVQ

SEQ ID NO: 3342 - protein, 95 aa, Homo sapiens; identical to SEQ ID NO: 3337
  Payload ID: 740;
  Gene Symbol: ARL17B;
  Gene Name: ADP-ribosylation factor-like 17B;
  ENSP ID: ENSP00000459131

SEQ ID NO: 3343 - protein, 125 aa, Homo sapiens; identical to SEQ ID NO: 3335
  Payload ID: 740;
  Gene Symbol: ARL17B;
  Gene Name: ADP-ribosylation factor-like 17B;
  Uniprot ID:  Q8IVW1;
  ENSP ID: ENSP00000459151

SEQ ID NO: 3344 - protein, 87 aa, Homo sapiens; identical to SEQ ID NO: 3336
  Payload ID: 740;
  Gene Symbol: ARL17B;
  Gene Name: ADP-ribosylation factor-like 17B;
  ENSP ID: ENSP00000459773

SEQ ID NO: 3345 - protein, 181 aa, Homo sapiens
  Payload ID: 740;
  Gene Symbol: ARL17B;
  Gene Name: ADP-ribosylation factor-like 17B;
  ENSP ID: ENSP00000460539
MGNIFEKLFKSLLGKKKMRILILSLDTAGKTTILYKLKLGETVPAVPTVGFCVETVEYKNNTFAVWDVGSHFKIRPLWQHFFQNTKGARSPGSTHQGSLASGVLPIKCSHVEFGMWKGGRSHPFLPHSSRCAGSGGQLDSILPHQSPAWGPWGCKDLSSGFPSFLTSSILWKSAVLLTPKA

SEQ ID NO: 3346 - protein, 88 aa, Homo sapiens; identical to SEQ ID NO: 3338
  Payload ID: 740;
  Gene Symbol: ARL17B;
  Gene Name: ADP-ribosylation factor-like 17B;
  ENSP ID: ENSP00000477704

SEQ ID NO: 3347 - protein, 125 aa, Homo sapiens; identical to SEQ ID NO: 3335
  Payload ID: 740;
  Gene Symbol: ARL17B;
  Gene Name: ADP-ribosylation factor-like 17B;
  Uniprot ID:  Q8IVW1;
  ENSP ID: ENSP00000479224

SEQ ID NO: 3348 - protein, 141 aa, Homo sapiens; identical to SEQ ID NO: 3333
  Payload ID: 740;
  Gene Symbol: ARL17B;
  Gene Name: ADP-ribosylation factor-like 17B;
  ENSP ID: ENSP00000479751

SEQ ID NO: 3349 - protein, 141 aa, Homo sapiens; identical to SEQ ID NO: 3333
  Payload ID: 740;
  Gene Symbol: ARL17B;
  Gene Name: ADP-ribosylation factor-like 17B;
  ENSP ID: ENSP00000481458

SEQ ID NO: 3350 - protein, 177 aa, Homo sapiens; identical to SEQ ID NO: 3334
  Payload ID: 740;
  Gene Symbol: ARL17B;
  Gene Name: ADP-ribosylation factor-like 17B;
  Uniprot ID:  Q8IVW1;
  ENSP ID: ENSP00000481838

SEQ ID NO: 3351 - protein, 125 aa, Homo sapiens; identical to SEQ ID NO: 3335
  Payload ID: 740;
  Gene Symbol: ARL17B;
  Gene Name: ADP-ribosylation factor-like 17B;
  Uniprot ID:  Q8IVW1;
  ENSP ID: ENSP00000482789

SEQ ID NO: 3352 - protein, 125 aa, Homo sapiens; identical to SEQ ID NO: 3335
  Payload ID: 740;
  Gene Symbol: ARL17B;
  Gene Name: ADP-ribosylation factor-like 17B;
  Uniprot ID:  Q8IVW1;
  ENSP ID: ENSP00000482856

SEQ ID NO: 3353 - protein, 177 aa, Homo sapiens; identical to SEQ ID NO: 3334
  Payload ID: 740;
  Gene Symbol: ARL17B;
  Gene Name: ADP-ribosylation factor-like 17B;
  Uniprot ID:  Q8IVW1;
  ENSP ID: ENSP00000483271

SEQ ID NO: 3354 - protein, 141 aa, Homo sapiens; identical to SEQ ID NO: 3333
  Payload ID: 740;
  Gene Symbol: ARL17B;
  Gene Name: ADP-ribosylation factor-like 17B;
  ENSP ID: ENSP00000483384

SEQ ID NO: 3355 - protein, 181 aa, Homo sapiens; identical to SEQ ID NO: 3345
  Payload ID: 740;
  Gene Symbol: ARL17B;
  Gene Name: ADP-ribosylation factor-like 17B;
  ENSP ID: ENSP00000485737

SEQ ID NO: 3356 - protein, 95 aa, Homo sapiens; identical to SEQ ID NO: 3337
  Payload ID: 740;
  Gene Symbol: ARL17B;
  Gene Name: ADP-ribosylation factor-like 17B;
  ENSP ID: ENSP00000485999

SEQ ID NO: 3357 - protein, 87 aa, Homo sapiens; identical to SEQ ID NO: 3336
  Payload ID: 740;
  Gene Symbol: ARL17B;
  Gene Name: ADP-ribosylation factor-like 17B;
  ENSP ID: ENSP00000486234

SEQ ID NO: 3358 - protein, 111 aa, Homo sapiens; identical to SEQ ID NO: 3341
  Payload ID: 740;
  Gene Symbol: ARL17B;
  Gene Name: ADP-ribosylation factor-like 17B;
  ENSP ID: ENSP00000486390
  MOD_RES (1)..(1): Any amino acid

SEQ ID NO: 3359 - protein, 125 aa, Homo sapiens; identical to SEQ ID NO: 3335
  Payload ID: 740;
  Gene Symbol: ARL17B;
  Gene Name: ADP-ribosylation factor-like 17B;
  Uniprot ID:  Q8IVW1;
  ENSP ID: ENSP00000487334

SEQ ID NO: 3360 - protein, 125 aa, Homo sapiens; identical to SEQ ID NO: 3335
  Payload ID: 740;
  Gene Symbol: ARL17B;
  Gene Name: ADP-ribosylation factor-like 17B;
  Uniprot ID:  Q8IVW1;
  ENSP ID: ENSP00000487605

SEQ ID NO: 3361 - protein, 181 aa, Homo sapiens; identical to SEQ ID NO: 3345
  Payload ID: 740;
  Gene Symbol: ARL17B;
  Gene Name: ADP-ribosylation factor-like 17B;
  ENSP ID: ENSP00000487735

SEQ ID NO: 3362 - protein, 95 aa, Homo sapiens; identical to SEQ ID NO: 3337
  Payload ID: 740;
  Gene Symbol: ARL17B;
  Gene Name: ADP-ribosylation factor-like 17B;
  ENSP ID: ENSP00000487838

SEQ ID NO: 3363 - protein, 111 aa, Homo sapiens; identical to SEQ ID NO: 3341
  Payload ID: 740;
  Gene Symbol: ARL17B;
  Gene Name: ADP-ribosylation factor-like 17B;
  ENSP ID: ENSP00000488136
  MOD_RES (1)..(1): Any amino acid

SEQ ID NO: 3364 - protein, 87 aa, Homo sapiens; identical to SEQ ID NO: 3336
  Payload ID: 740;
  Gene Symbol: ARL17B;
  Gene Name: ADP-ribosylation factor-like 17B;
  ENSP ID: ENSP00000488599

SEQ ID NO: 3365 - protein, 184 aa, Homo sapiens
  Payload ID: 741;
  Gene Symbol: ARL2;
  Gene Name: ADP-ribosylation factor-like 2;
  Uniprot ID:  P36404;
  ENSP ID: ENSP00000246747
MGLLTILKKMKQKERELRLLMLGLDNAGKTTILKKFNGEDIDTISPTLGFNIKTLEHRGFKLNIWDVGGQKSLRSYWRNYFESTDGLIWVVDSADRQRMQDCQRELQSLLVEERLAGATLLIFANKQDLPGALSSNAIREVLELDSIRSHHWCIQGCSAVTGENLLPGIDWLLDDISSRIFTAD

SEQ ID NO: 3366 - protein, 157 aa, Homo sapiens
  Payload ID: 741;
  Gene Symbol: ARL2;
  Gene Name: ADP-ribosylation factor-like 2;
  Uniprot ID:  P36404;
  ENSP ID: ENSP00000432971
MGLLTILKKMKQKERELRLLMLGLDNAGKTTILKKFNGEDIDTISPTLGFNIKTLEHRGFKLNIWDVGGQKSLRSYWRNYFESTDGLIWVVDSADRQRMQDCQRELQSLLVEEVLELDSIRSHHWCIQGCSAVTGENLLPGIDWLLDDISSRIFTAD

SEQ ID NO: 3367 - protein, 184 aa, Homo sapiens; identical to SEQ ID NO: 3365
  Payload ID: 741;
  Gene Symbol: ARL2;
  Gene Name: ADP-ribosylation factor-like 2;
  Uniprot ID:  P36404;
  ENSP ID: ENSP00000436021

SEQ ID NO: 3368 - protein, 163 aa, Homo sapiens
  Payload ID: 742;
  Gene Symbol: ARL2BP;
  Gene Name: ADP-ribosylation factor-like 2 binding prt;
  Uniprot ID:  Q9Y2Y0;
  ENSP ID: ENSP00000219204
MDALEGESFALSFSSASDAEFDAVVGYLEDIIMDDEFQLLQRNFMDKYYLEFEDTEENKLIYTPIFNEYISLVEKYIEEQLLQRIPEFNMAAFTTTLQHHKDEVAGDIFDMLLTFTDFLAFKEMFLDYRAEKEGRGLDLSSGLVVTSLCKSSSLPASQNNLRH

SEQ ID NO: 3369 - protein, 171 aa, Homo sapiens
  Payload ID: 742;
  Gene Symbol: ARL2BP;
  Gene Name: ADP-ribosylation factor-like 2 binding prt;
  ENSP ID: ENSP00000454237
  MOD_RES (1)..(1): Any amino acid
XLEGESFALSFSSASDAEFDAVVGYLEDIIMDDEFQLLQRNFMDKYYLEFEDTEENKLIYTPIFNEYISLVEKYIEEQLLQRIPEFNMAAFTTTLQHHKDEVAGDIFDMLLTFTDFLAFKEMFLDYRALPRTICGTRSYLQPMNGIILDVTSPIGSAHDDRTHLGKTDSVM

SEQ ID NO: 3370 - protein, 123 aa, Homo sapiens
  Payload ID: 742;
  Gene Symbol: ARL2BP;
  Gene Name: ADP-ribosylation factor-like 2 binding prt;
  ENSP ID: ENSP00000457465
MDALEGESFALSFSSASDAEFDAVVGYLEDIIMEKYIEEQLLQRIPEFNMAAFTTTLQHHKDEVAGDIFDMLLTFTDFLAFKEMFLDYRAEKEGRGLDLSSGLVVTSLCKSSSLPASQNNLRH

SEQ ID NO: 3371 - protein, 182 aa, Homo sapiens
  Payload ID: 743;
  Gene Symbol: ARL3;
  Gene Name: ADP-ribosylation factor-like 3;
  Uniprot ID:  P36405;
  ENSP ID: ENSP00000260746
MGLLSILRKLKSAPDQEVRILLLGLDNAGKTTLLKQLASEDISHITPTQGFNIKSVQSQGFKLNVWDIGGQRKIRPYWKNYFENTDILIYVIDSADRKRFEETGQELAELLEEEKLSCVPVLIFANKQDLLTAAPASEIAEGLNLHTIRDRVWQIQSCSALTGEGVQDGMNWVCKNVNAKKK

SEQ ID NO: 3372 - protein, 200 aa, Homo sapiens
  Payload ID: 744;
  Gene Symbol: ARL4A;
  Gene Name: ADP-ribosylation factor-like 4A;
  Uniprot ID:  P40617;
  ENSP ID: ENSP00000349250
MGNGLSDQTSILSNLPSFQSFHIVILGLDCAGKTTVLYRLQFNEFVNTVPTKGFNTEKIKVTLGNSKTVTFHFWDVGGQEKLRPLWKSYTRCTDGIVFVVDSVDVERMEEAKTELHKITRISENQGVPVLIVANKQDLRNSLSLSEIEKLLAMGELSSSTPWHLQPTCAIIGDGLKEGLEKLHDMIIKRRKMLRQQKKKR

SEQ ID NO: 3373 - protein, 200 aa, Homo sapiens; identical to SEQ ID NO: 3372
  Payload ID: 744;
  Gene Symbol: ARL4A;
  Gene Name: ADP-ribosylation factor-like 4A;
  Uniprot ID:  P40617;
  ENSP ID: ENSP00000379897

SEQ ID NO: 3374 - protein, 200 aa, Homo sapiens; identical to SEQ ID NO: 3372
  Payload ID: 744;
  Gene Symbol: ARL4A;
  Gene Name: ADP-ribosylation factor-like 4A;
  Uniprot ID:  P40617;
  ENSP ID: ENSP00000379898

SEQ ID NO: 3375 - protein, 200 aa, Homo sapiens; identical to SEQ ID NO: 3372
  Payload ID: 744;
  Gene Symbol: ARL4A;
  Gene Name: ADP-ribosylation factor-like 4A;
  Uniprot ID:  P40617;
  ENSP ID: ENSP00000379899

SEQ ID NO: 3376 - protein, 200 aa, Homo sapiens; identical to SEQ ID NO: 3372
  Payload ID: 744;
  Gene Symbol: ARL4A;
  Gene Name: ADP-ribosylation factor-like 4A;
  Uniprot ID:  P40617;
  ENSP ID: ENSP00000385236

SEQ ID NO: 3377 - protein, 50 aa, Homo sapiens
  Payload ID: 744;
  Gene Symbol: ARL4A;
  Gene Name: ADP-ribosylation factor-like 4A;
  ENSP ID: ENSP00000397651
MGNGLSDQTSILSNLPSFQSFHIVILGLDCAGKTTVLYRLQFNEFVNTVP

SEQ ID NO: 3378 - protein, 201 aa, Homo sapiens
  Payload ID: 745;
  Gene Symbol: ARL4C;
  Gene Name: ADP-ribosylation factor-like 4C;
  Uniprot ID:  P56559;
  ENSP ID: ENSP00000339754
MGNISSNISAFQSLHIVMLGLDSAGKTTVLYRLKFNEFVNTVPTIGFNTEKIKLSNGTAKGISCHFWDVGGQEKLRPLWKSYSRCTDGIIYVVDSVDVDRLEEAKTELHKVTKFAENQGTPLLVIANKQDLPKSLPVAEIEKQLALHELIPATTYHVQPACAIIGEGLTEGMDKLYEMILKRRKSLKQKKKRTGDLRSCEV

SEQ ID NO: 3379 - protein, 192 aa, Homo sapiens
  Payload ID: 745;
  Gene Symbol: ARL4C;
  Gene Name: ADP-ribosylation factor-like 4C;
  Uniprot ID:  P56559;
  ENSP ID: ENSP00000375057
MGNISSNISAFQSLHIVMLGLDSAGKTTVLYRLKFNEFVNTVPTIGFNTEKIKLSNGTAKGISCHFWDVGGQEKLRPLWKSYSRCTDGIIYVVDSVDVDRLEEAKTELHKVTKFAENQGTPLLVIANKQDLPKSLPVAEIEKQLALHELIPATTYHVQPACAIIGEGLTEGMDKLYEMILKRRKSLKQKKKR

SEQ ID NO: 3380 - protein, 201 aa, Homo sapiens
  Payload ID: 746;
  Gene Symbol: ARL4D;
  Gene Name: ADP-ribosylation factor-like 4D;
  Uniprot ID:  P49703;
  ENSP ID: ENSP00000322628
MGNHLTEMAPTASSFLPHFQALHVVVIGLDSAGKTSLLYRLKFKEFVQSVPTKGFNTEKIRVPLGGSRGITFQVWDVGGQEKLRPLWRSYTRRTDGLVFVVDAAEAERLEEAKVELHRISRASDNQGVPVLVLANKQDQPGALSAAEVEKRLAVRELAAATLTHVQGCSAVDGLGLQQGLERLYEMILKRKKAARGGKKRR

SEQ ID NO: 3381 - protein, 179 aa, Homo sapiens
  Payload ID: 747;
  Gene Symbol: ARL5A;
  Gene Name: ADP-ribosylation factor-like 5A;
  Uniprot ID:  Q9Y689;
  ENSP ID: ENSP00000295087
MGILFTRIWRLFNHQEHKVIIVGLDNAGKTTILYQFSMNEVVHTSPTIGSNVEEIVINNTRFLMWDIGGQESLRSSWNTYYTNTEFVIVVVDSTDRERISVTREELYKMLAHEDLRKAGLLIFANKQDVKECMTVAEISQFLKLTSIKDHQWHIQACCALTGEGLCQGLEWMMSRLKIR

SEQ ID NO: 3382 - protein, 77 aa, Homo sapiens
  Payload ID: 747;
  Gene Symbol: ARL5A;
  Gene Name: ADP-ribosylation factor-like 5A;
  ENSP ID: ENSP00000393716
MNEVVHTSPTIGSNVEEIVINNTRFLMWDIGGQESLRSSWNTYYTNTEFVIVVVDSTDRERISVTREELYKMLAHEK

SEQ ID NO: 3383 - protein, 142 aa, Homo sapiens
  Payload ID: 747;
  Gene Symbol: ARL5A;
  Gene Name: ADP-ribosylation factor-like 5A;
  Uniprot ID:  Q9Y689;
  ENSP ID: ENSP00000394626
MNEVVHTSPTIGSNVEEIVINNTRFLMWDIGGQESLRSSWNTYYTNTEFVIVVVDSTDRERISVTREELYKMLAHEDLRKAGLLIFANKQDVKECMTVAEISQFLKLTSIKDHQWHIQACCALTGEGLCQGLEWMMSRLKIR

SEQ ID NO: 3384 - protein, 142 aa, Homo sapiens; identical to SEQ ID NO: 3383
  Payload ID: 747;
  Gene Symbol: ARL5A;
  Gene Name: ADP-ribosylation factor-like 5A;
  Uniprot ID:  Q9Y689;
  ENSP ID: ENSP00000415950

SEQ ID NO: 3385 - protein, 179 aa, Homo sapiens
  Payload ID: 748;
  Gene Symbol: ARL5B;
  Gene Name: ADP-ribosylation factor-like 5B;
  Uniprot ID:  Q96KC2;
  ENSP ID: ENSP00000366487
MGLIFAKLWSLFCNQEHKVIIVGLDNAGKTTILYQFLMNEVVHTSPTIGSNVEEIVVKNTHFLMWDIGGQESLRSSWNTYYSNTEFIILVVDSIDRERLAITKEELYRMLAHEDLRKAAVLIFANKQDMKGCMTAAEISKYLTLSSIKDHPWHIQSCCALTGEGLCQGLEWMTSRIGVR

SEQ ID NO: 3386 - protein, 179 aa, Homo sapiens
  Payload ID: 749;
  Gene Symbol: ARL5C;
  Gene Name: ADP-ribosylation factor-like 5C;
  Uniprot ID:  A6NH57;
  ENSP ID: ENSP00000269586
MGQLIAKLMSIFGNQEHTVIIVGLDNEGKTTILYRFLTNEVVHMCPTIGSNVEEIILPKTHFFMWDIVRPEALSFIWNTYYSNTEFIILVIDSTDRDRLLTTREELYKMLAHEALQDASVLIFANKQDVKDSMRMVEISHFLTLSTIKDHSWHIQGCCALTREGLPARLQWMESQAAAN

SEQ ID NO: 3387 - protein, 99 aa, Homo sapiens
  Payload ID: 749;
  Gene Symbol: ARL5C;
  Gene Name: ADP-ribosylation factor-like 5C;
  ENSP ID: ENSP00000466347
NTYYSNTEFIILVIDSTDRDRLLTTREELYKMLAHEALQDASVLIFANKQDVKDSMRMVEISHFLTLSTIKDHSWHIQGCCALTREGLVAALPGSLGPG

SEQ ID NO: 3388 - protein, 186 aa, Homo sapiens
  Payload ID: 750;
  Gene Symbol: ARL6;
  Gene Name: ADP-ribosylation factor-like 6;
  Uniprot ID:  Q9H0F7;
  ENSP ID: ENSP00000337722
MGLLDRLSVLLGLKKKEVHVLCLGLDNSGKTTIINKLKPSNAQSQNILPTIGFSIEKFKSSSLSFTVFDMSGQGRYRNLWEHYYKEGQAIIFVIDSSDRLRMVVAKEELDTLLNHPDIKHRRIPILFFANKMDLRDAVTSVKVSQLLCLENIKDKPWHICASDAIKGEGLQEGVDWLQDQIQTVKT

SEQ ID NO: 3389 - protein, 186 aa, Homo sapiens; identical to SEQ ID NO: 3388
  Payload ID: 750;
  Gene Symbol: ARL6;
  Gene Name: ADP-ribosylation factor-like 6;
  Uniprot ID:  Q9H0F7;
  ENSP ID: ENSP00000377756

SEQ ID NO: 3390 - protein, 186 aa, Homo sapiens; identical to SEQ ID NO: 3388
  Payload ID: 750;
  Gene Symbol: ARL6;
  Gene Name: ADP-ribosylation factor-like 6;
  Uniprot ID:  Q9H0F7;
  ENSP ID: ENSP00000418057

SEQ ID NO: 3391 - protein, 121 aa, Homo sapiens
  Payload ID: 750;
  Gene Symbol: ARL6;
  Gene Name: ADP-ribosylation factor-like 6;
  ENSP ID: ENSP00000418740
MGLLDRLSVLLGLKKKEVHVLCLGLDNSGKTTIINKLKPSNAQSQNILPTIGFSIEKFKSSSLSFTVFDMSGQGRYRNLWEHYYKEGQAIIFVIDSSDRLRMVVAKEELDTLLNHPDIKHR

SEQ ID NO: 3392 - protein, 186 aa, Homo sapiens; identical to SEQ ID NO: 3388
  Payload ID: 750;
  Gene Symbol: ARL6;
  Gene Name: ADP-ribosylation factor-like 6;
  Uniprot ID:  Q9H0F7;
  ENSP ID: ENSP00000419619

SEQ ID NO: 3393 - protein, 54 aa, Homo sapiens
  Payload ID: 750;
  Gene Symbol: ARL6;
  Gene Name: ADP-ribosylation factor-like 6;
  ENSP ID: ENSP00000419934
  MOD_RES (1)..(1): Any amino acid
XEELDTLLNHPDIKHRRIPILFFANKMDLRDAVTSVKVSQLLCLENIKDKPWHI

SEQ ID NO: 3394 - protein, 147 aa, Homo sapiens
  Payload ID: 750;
  Gene Symbol: ARL6;
  Gene Name: ADP-ribosylation factor-like 6;
  ENSP ID: ENSP00000488530
ILPTIGFSIEKFKSSSLSFTVFDMSGQGRYRNLWEHYYKEGQAIIFVIDSSDRLRMVVAKEELDTLLNHPDIKHRRIPILFFANKMDLRDAVTSVKVSQLLCLENIKDKPWHICASDAIKGEGLQEGVDWLQEKTIQSDPDCEDMKR

SEQ ID NO: 3395 - protein, 203 aa, Homo sapiens
  Payload ID: 751;
  Gene Symbol: ARL6IP1;
  Gene Name: ADP-ribosylation factor-like 6 interacting prt 1;
  Uniprot ID:  Q15041;
  ENSP ID: ENSP00000306788
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIVTSLLLLPGLNQHGIILKYIGMAKREINKLLKQKEKKNE

SEQ ID NO: 3396 - protein, 174 aa, Homo sapiens
  Payload ID: 751;
  Gene Symbol: ARL6IP1;
  Gene Name: ADP-ribosylation factor-like 6 interacting prt 1;
  Uniprot ID:  Q15041;
  ENSP ID: ENSP00000440048
MLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIVTSLLLLPGLNQHGIILKYIGMAKREINKLLKQKEKKNE

SEQ ID NO: 3397 - protein, 101 aa, Homo sapiens
  Payload ID: 751;
  Gene Symbol: ARL6IP1;
  Gene Name: ADP-ribosylation factor-like 6 interacting prt 1;
  ENSP ID: ENSP00000455341
MAEGDNRSTNLLAAETASLEEQLQGWGEVMLMADKVLRWERAWFPPAIMAPRIFGSNKWTTEQQQRFHEICSNLVKTRRRAVGWWKRLFTLKEEKPKMYFM

SEQ ID NO: 3398 - protein, 99 aa, Homo sapiens
  Payload ID: 751;
  Gene Symbol: ARL6IP1;
  Gene Name: ADP-ribosylation factor-like 6 interacting prt 1;
  ENSP ID: ENSP00000456596
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKCTS

SEQ ID NO: 3399 - protein, 88 aa, Homo sapiens
  Payload ID: 751;
  Gene Symbol: ARL6IP1;
  Gene Name: ADP-ribosylation factor-like 6 interacting prt 1;
  ENSP ID: ENSP00000457372
MAEGDNRSTNLLAAETASLEEQLQGWGEVMLMADKVLRWERAWFPPAIMVTSLLLLPGLNQHGIILKYIGMAKREINKLLKQKEKKNE

SEQ ID NO: 3400 - protein, 421 aa, Homo sapiens
  Payload ID: 752;
  Gene Symbol: ARL6IP4;
  Gene Name: ADP-ribosylation factor-like 6 interacting prt 4;
  Uniprot ID:  Q66PJ3;
  ENSP ID: ENSP00000313422
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSRKDTSRNCSASTSQGRKASTAPGAEASPSPCITERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINKQATRGDCLAFQMRAGLLP

SEQ ID NO: 3401 - protein, 181 aa, Homo sapiens
  Payload ID: 752;
  Gene Symbol: ARL6IP4;
  Gene Name: ADP-ribosylation factor-like 6 interacting prt 4;
  ENSP ID: ENSP00000350532
MAHVGSRKRSRSRSRSRGRGSEKRKKKSRKDTSRNCSASTSQGRKASTAPGAEERSKQKARRRTRSSSSSSSSSSSSSSSSSSSSSSSSSDGRKKRGKYKDKRRKKKKKRKKLKKKGKEKAEAQQSIIRKVVDPETGRTRLIKGDGEVLEEIVTKERHREINKQATRGDCLAFQMRAGLLP

SEQ ID NO: 3402 - protein, 399 aa, Homo sapiens
  Payload ID: 752;
  Gene Symbol: ARL6IP4;
  Gene Name: ADP-ribosylation factor-like 6 interacting prt 4;
  Uniprot ID:  Q66PJ3;
  ENSP ID: ENSP00000376230
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSRKDTSRNCSASTSQERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINKVGVAPLPAIRPQLCL

SEQ ID NO: 3403 - protein, 216 aa, Homo sapiens [sequence omitted]

SEQ ID NO: 3404 - protein, 229 aa, Homo sapiens
  Payload ID: 752;
  Gene Symbol: ARL6IP4;
  Gene Name: ADP-ribosylation factor-like 6 interacting prt 4;
  ENSP ID: ENSP00000396365
MAHVGSRKRSRSRSRSRGRGSEKRKKKSRKDTSRNCSASTSQGRKASTAPGAEERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINKQATRGDCLAFQMRAGLLP

SEQ ID NO: 3405 - protein, 226 aa, Homo sapiens
  Payload ID: 752;
  Gene Symbol: ARL6IP4;
  Gene Name: ADP-ribosylation factor-like 6 interacting prt 4;
  Uniprot ID:  Q66PJ3;
  ENSP ID: ENSP00000396723
MAHVGSRKRSRSRSRSRGRGSEKRKKKSRKDTSRNCSASTSQASPSPCITERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINKQATRGDCLAFQMRAGLLP

SEQ ID NO: 3406 - protein, 218 aa, Homo sapiens
  Payload ID: 752;
  Gene Symbol: ARL6IP4;
  Gene Name: ADP-ribosylation factor-like 6 interacting prt 4;
  ENSP ID: ENSP00000406036
MAHVGSRKRSRSRSRSRGRGSEKRKKKSRKDTSRNCSASTSQERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINKQATRGDCLAFQMRAGLLP

SEQ ID NO: 3407 - protein, 170 aa, Homo sapiens
  Payload ID: 752;
  Gene Symbol: ARL6IP4;
  Gene Name: ADP-ribosylation factor-like 6 interacting prt 4;
  ENSP ID: ENSP00000413132
MAHVGSRKRSRSRSRSRGRGSEKRKKKSRKDTSRNCSASTSQERSKQKARRRTRSSSSSSSSSSSSSSSSSSSSSSSSSDGRKKRGKYKDKRRKKKKKRKKLKKKGKEKAEAQQSIIRKVVDPETGRTRLIKGDGEVLEEIVTKERHREINKQATRGDCLAFQMRAGLLP

SEQ ID NO: 3408 - protein, 413 aa, Homo sapiens
  Payload ID: 752;
  Gene Symbol: ARL6IP4;
  Gene Name: ADP-ribosylation factor-like 6 interacting prt 4;
  Uniprot ID:  Q66PJ3;
  ENSP ID: ENSP00000414847
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSRKDTSRNCSASTSQGRKASTAPGAEERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINKQATRGDCLAFQMRAGLLP

SEQ ID NO: 3409 - protein, 215 aa, Homo sapiens [sequence omitted]

SEQ ID NO: 3410 - protein, 211 aa, Homo sapiens
  Payload ID: 752;
  Gene Symbol: ARL6IP4;
  Gene Name: ADP-ribosylation factor-like 6 interacting prt 4;
  ENSP ID: ENSP00000441406
MAHVGSRKRSRSRSRSRGRGSEKRKKKSRKDTSRNCSASTSQGRKASTAPGAEERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINK

SEQ ID NO: 3411 - protein, 307 aa, Homo sapiens [sequence omitted]

SEQ ID NO: 3412 - protein, 402 aa, Homo sapiens
  Payload ID: 752;
  Gene Symbol: ARL6IP4;
  Gene Name: ADP-ribosylation factor-like 6 interacting prt 4;
  Uniprot ID:  Q66PJ3;
  ENSP ID: ENSP00000442718
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSRKDTSRNCSASTSQERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINKQATRGDCLAFQMRAGLLP

SEQ ID NO: 3413 - protein, 188 aa, Homo sapiens
  Payload ID: 753;
  Gene Symbol: ARL6IP5;
  Gene Name: ADP-ribosylation factor-like 6 interacting prt 5;
  Uniprot ID:  O75915;
  ENSP ID: ENSP00000273258
MDVNIAPLRAWDDFFPGSDRFARPDFRDISKWNNRVVSNLLYYQTNYLVVAAMMISIVGFLSPFNMILGGIVVVLVFTGFVWAAHNKDVLRRMKKRYPTTFVMVVMLASYFLISMFGGVMVFVFGITFPLLLMFIHASLRLRNLKNKLENKMEGIGLKRTPMGIVLDALEQQEEGINRLTDYISKVKE

SEQ ID NO: 3414 - protein, 59 aa, Homo sapiens
  Payload ID: 753;
  Gene Symbol: ARL6IP5;
  Gene Name: ADP-ribosylation factor-like 6 interacting prt 5;
  ENSP ID: ENSP00000419021
MDVNIAPLRAWDDFFPGSDRFARPDFRDISKWNNRVVSNLLYYQTNYLVVAAMMISIVG

SEQ ID NO: 3415 - protein, 93 aa, Homo sapiens
  Payload ID: 753;
  Gene Symbol: ARL6IP5;
  Gene Name: ADP-ribosylation factor-like 6 interacting prt 5;
  ENSP ID: ENSP00000419374
MDVNIAPLRAWDDFFPGSDRFARPDFRDISKWNNRVVSNLLYYQTNYLVVAAMMISIVGLECNGVISAHCNLHLLSSSDSPASASQVAGITGF

SEQ ID NO: 3416 - protein, 88 aa, Homo sapiens
  Payload ID: 753;
  Gene Symbol: ARL6IP5;
  Gene Name: ADP-ribosylation factor-like 6 interacting prt 5;
  ENSP ID: ENSP00000420138
MDVNIAPLRAWDDFFPGSDRFARPDFRDISKWNNRVVSNLLYYQTNYLVVAAMMISIVGFLSPFNPPIVSEVSRVFMKSNGKWITRFL

SEQ ID NO: 3417 - protein, 226 aa, Homo sapiens
  Payload ID: 754;
  Gene Symbol: ARL6IP6;
  Gene Name: ADP-ribosylation factor-like 6 interacting prt 6;
  Uniprot ID:  Q8N6S5;
  ENSP ID: ENSP00000315357
MSFAESGWRSALRRRGPGTPGPVARPSYSSFTQGDSWGEGEVDEEEGCDQVARDLRAEFSAGAWSEPRKRSVLPPDGNGSPVLPDKRNGIFPAAAGSRAQPRRWPVQVLSILCSLLFAILLAFLLAIAYLIVKELHAENLKNEDDVDTGLLGFWTLLIISLTAGFSCCSFSWTVTYFDSFEPGMFPPTPLSPARFKKLTGHSFHMGYSMAILNGIVAALTVAWCLM

SEQ ID NO: 3418 - protein, 38 aa, Homo sapiens
  Payload ID: 754;
  Gene Symbol: ARL6IP6;
  Gene Name: ADP-ribosylation factor-like 6 interacting prt 6;
  ENSP ID: ENSP00000395052
  MOD_RES (1)..(1): Any amino acid
XCSLLFAILLAFLLAIAYLIVKAFSGLQMAWHLKPYNA

SEQ ID NO: 3419 - protein, 66 aa, Homo sapiens
  Payload ID: 754;
  Gene Symbol: ARL6IP6;
  Gene Name: ADP-ribosylation factor-like 6 interacting prt 6;
  ENSP ID: ENSP00000399141
AQPRRWPVQVLSILCSLLFAILLAFLLAIAYLIVKELHAENLKNEDDVDTGLLGIICISRKFSLML

SEQ ID NO: 3420 - protein, 186 aa, Homo sapiens
  Payload ID: 755;
  Gene Symbol: ARL8A;
  Gene Name: ADP-ribosylation factor-like 8A;
  Uniprot ID:  Q96BM9;
  ENSP ID: ENSP00000272217
MIALFNKLLDWFKALFWKEEMELTLVGLQYSGKTTFVNVIASGQFNEDMIPTVGFNMRKITKGNVTIKLWDIGGQPRFRSMWERYCRGVSAIVYMVDAADQEKIEASKNELHNLLDKPQLQGIPVLVLGNKRDLPGALDEKELIEKMNLSAIQDREICCYSISCKEKDNIDITLQWLIQHSKSRRS

SEQ ID NO: 3421 - protein, 147 aa, Homo sapiens
  Payload ID: 755;
  Gene Symbol: ARL8A;
  Gene Name: ADP-ribosylation factor-like 8A;
  ENSP ID: ENSP00000485023
MIALFNKLLDWFKALFWKEEMELTLVGLQYSGKTTFVNVIASGQFNEDMIPTVGFNMRKITKGNVTIKLWDIGGQPRFRSMWERYCRGVSAIVYMVDAADQEKIEASKNELHNLLDKPQLQGIPESVCHPGPRDLLLLHLLQRKGQH

SEQ ID NO: 3422 - protein, 186 aa, Homo sapiens
  Payload ID: 756;
  Gene Symbol: ARL8B;
  Gene Name: ADP-ribosylation factor-like 8B;
  Uniprot ID:  Q9NVJ2;
  ENSP ID: ENSP00000256496
MLALISRLLDWFRSLFWKEEMELTLVGLQYSGKTTFVNVIASGQFSEDMIPTVGFNMRKVTKGNVTIKIWDIGGQPRFRSMWERYCRGVNAIVYMIDAADREKIEASRNELHNLLDKPQLQGIPVLVLGNKRDLPNALDEKQLIEKMNLSAIQDREICCYSISCKEKDNIDITLQWLIQHSKSRRS

SEQ ID NO: 3423 - protein, 103 aa, Homo sapiens
  Payload ID: 756;
  Gene Symbol: ARL8B;
  Gene Name: ADP-ribosylation factor-like 8B;
  ENSP ID: ENSP00000400831
MIRSASWVWLLPPAGVRPCRAGAPRSRWRVRAEARSCGSRRRRRSSVLPSVLAPGRHHAGAHLPPAGLVPFALLEGRDGADARGAAVLGQDHLRQCHRVRSIQ

SEQ ID NO: 3424 - protein, 163 aa, Homo sapiens
  Payload ID: 756;
  Gene Symbol: ARL8B;
  Gene Name: ADP-ribosylation factor-like 8B;
  Uniprot ID:  Q9NVJ2;
  ENSP ID: ENSP00000402996
MLALISRLLDWFRSLFWKEEMELTLVGLQYSGKTTFVNVIASGQFSEDMIPTVGFNMRKVTKGNVTIKIWDIGGQPRFRSMWERYCRGVNAIVYMIDAADREKIEASRNELHNLLDKPQLQGIPISHFSGLFSIQNLEEAEASPEVFQSFLAIILELLSVPLK

SEQ ID NO: 3425 - protein, 102 aa, Homo sapiens
  Payload ID: 756;
  Gene Symbol: ARL8B;
  Gene Name: ADP-ribosylation factor-like 8B;
  ENSP ID: ENSP00000405196
MIRSASWVWLLPPAGVRPCRAGAPRSRWRVRAEARSCGSRRRRRSSVLPSVLAPGRHHAGAHLPPAGLVPFALLEGRDGADARGAAVLGQDHLRQCHRDQES

SEQ ID NO: 3426 - protein, 186 aa, Homo sapiens; identical to SEQ ID NO: 3422
  Payload ID: 756;
  Gene Symbol: ARL8B;
  Gene Name: ADP-ribosylation factor-like 8B;
  Uniprot ID:  Q9NVJ2;
  ENSP ID: ENSP00000479202

SEQ ID NO: 3427 - protein, 123 aa, Homo sapiens
  Payload ID: 757;
  Gene Symbol: ARL9;
  Gene Name: ADP-ribosylation factor-like 9;
  Uniprot ID:  Q6T311;
  ENSP ID: ENSP00000353210
MEFLEIGGSKPFRSYWEMYLSKGLLLIFVVDSADHSRLPEAKKYLHQLIAANPVLPLVVFANKQDLEAAYHITDIHEALALSEVGNDRKMFLFGTYLTKNGSEIPSTMQDAKDLIAQLAADVQ

SEQ ID NO: 3428 - protein, 272 aa, Homo sapiens
  Payload ID: 758;
  Gene Symbol: ADPRHL1;
  Gene Name: ADP-ribosylhydrolase like 1;
  Uniprot ID:  Q8NDY3;
  ENSP ID: ENSP00000348894
MVRCYVEIVEKLPERRPDPATIEGCAQLKPNNYLLAWHTPFNEKGSGFGAATKAMCIGLRYWKPERLETLIEVSVECGRMTHNHPTGFLGSLCTALFVSFAAQGKPLVQWGRDMLRAVPLAEEYCRKTIRHTAEYQEHWFYFEAKWQFYLEERKISKDSENKAIFPDNYDAEEREKTYRKWSSEGRGGRRGHDAPMIAYDALLAAGNSWTELCHRAMFHGGESAATGTIAGCLFGLLYGLDLVPKGLYQDLEDKEKLEDLGAALYRLSTEEK

SEQ ID NO: 3429 - protein, 354 aa, Homo sapiens
  Payload ID: 758;
  Gene Symbol: ADPRHL1;
  Gene Name: ADP-ribosylhydrolase like 1;
  Uniprot ID:  Q8NDY3;
  ENSP ID: ENSP00000364567
MEKFKAAMLLGSVGDALGYRNVCKENSTVGMKIQEELQRSGGLDHLVLSPGEWPVSDNTIMHIATAEALTTDYWCLDDLYREMVRCYVEIVEKLPERRPDPATIEGCAQLKPNNYLLAWHTPFNEKGSGFGAATKAMCIGLRYWKPERLETLIEVSVECGRMTHNHPTGFLGSLCTALFVSFAAQGKPLVQWGRDMLRAVPLAEEYCRKTIRHTAEYQEHWFYFEAKWQFYLEERKISKDSENKAIFPDNYDAEEREKTYRKWSSEGRGGRRGHDAPMIAYDALLAAGNSWTELCHRAMFHGGESAATGTIAGCLFGLLYGLDLVPKGLYQDLEDKEKLEDLGAALYRLSTEEK

SEQ ID NO: 3430 - protein, 176 aa, Homo sapiens
  Payload ID: 758;
  Gene Symbol: ADPRHL1;
  Gene Name: ADP-ribosylhydrolase like 1;
  ENSP ID: ENSP00000416213
MVRCYVEIVEKLPERRPDPATIEGCAQLKPNNYLLAWHTPFNEKGSGFGAATKAMCIGLRYWKPERLETLIEVSVECGRMTHNHPTGFLGSLCTALFVSFAAQGKPLVQWGRDMLRAVPLAEEYCRKTIRHTAEYQEHWFYFEAKWQFYLEERKISKDSENKAIFPDNYDAEEREK

SEQ ID NO: 3431 - protein, 1967 aa, Homo sapiens
  Payload ID: 758;
  Gene Symbol: ADPRHL1;
  Gene Name: ADP-ribosylhydrolase like 1;
  ENSP ID: ENSP00000489048
MEKFKAAMLLGSVGDALGYRNVCKENSTVGMKIQEELQRSGGLDHLVLSPGEWPVSDNTIMHIATAEALTTDYWCLDDLYREMVRCYVEIVEKLPERRPDPATIEGCAQLKPNNYLLAWHTPFNEKGSGFGAATKAMCIGLRYWKPERLETLIEVSVECGRMTHNHPTGFLGSLCTALFVSFAAQGKPLVQWGRDMLRAVPLAEEYCRKTIRHTAEYQEHWFYFEAKWQFYLEERKISKDSENKAIFPDNYDAEEREKTYRKWSSEGRGGRRGHDAPMIAYDALLAAGNSWTELCHRAMFHGGESAATGTIAGCLFGLLYGLDLVPKGLYQDLEDKEKLEDLGAALYRLSTEENRKSSKTCSDVMSVDAQTLKKKMGKLACDPAAHSILSSLLLYVTGRADRPPGTEAGGSRPSHQPQTQEATQRPTRFQLLQAKFLGTGRERYLKRTREVGRLISKDKQGPGGGLVGATINKLLEKTKEPAPKPCLSEKPRWGHPAGKSTVKNILKIFLAAEEKEAKEKEAREKPPVERPKAARGLLPKIMGKSSVLSKLREKFEQNSCLCSEASALRLHTQERKKRNLQRKRMHRPEVRVLHTATMASTCVKMPPARFLACTAEPLPALSIATVVCGPRSWLSHCTKISHSEARRPPRGEASVPPSARETGPSGNKAVGKGPLEEEPQRQPRPSKPVTPQVMAQRDGHAVPSLAFSCAPCTGGVLPGLVPASSPLGPASPWGTGSAGGDGTADPTAESTAGGVQEVRGARLTWPPGPPGECAGEGPEITMTVCSSEDEREGAGFPDPGRDPLFATQKYFPEQKVPEHIPPLNAPSVQAARRTQPATEPPRITVQIPVVHEMPAPPTRLQNMSSGENKPCICGGENVVENAHTEFPTVTENRRGHRAPVELSKLSGMQAGLSASSPQGPRAAPRLAAARGAVGADHSVPETLLTQRLQTDPAGGKENKGSFENSHGPRNPDDISGERTSELRDVKHPLPESNEISMQKKGSATNDPAASQNLLRGNTSHASSSQQVPSPTGRNPTGAPTSLAASSKGRTGPEGVTPMGMTVPGALEECRRPLLIESSQPLKAAEEITSHDVRENPLSSLNEPPKPGMKACGAMAAAGSVASRATPAPAPGSTQSPGDRTAGEPETLGQWGSRALSESHPRGEALPRDPHSHGLLAPGGSLEPKSGAAGRSLLRGVALVQHPEDIATLARHPEDAAALARHPEAARLYISNTSAASRHTAAVGGRKDVAVEGNLLGFSTESGIPASDHPRPQARSVAESPSYGPGLPPSPPENPQAKGREGVRFPRGAEPDHLLPAVPPAEVDMGWVGGTHQRGPPHLQAHLPPTAGDTQAKLRASVPEPRTQAGESQERPLTQADLGRQQSHQAQEETPQPGDAGKRVAPSGSKVVLNPAKEPQTWWAQDLAGDKGMAIGVGGACQRSDQGQQHLQGPWEERGRSTAWGEGTRAARNPAVPPGEPEGPGSPAAQGQAQKQVQEWDRGQVQGHAQEQAQWQTQIEAQGQAQEQAQGGTQGHSQGQAQKQFQNWAQGQAQGHAQEQAQWQTQIEAQGQAQEPAQGGAQGQVQGQAQKWAQGQIQGQAQKQVQGEVQKWAQEEAQGQAQWQTQIKAQKWAQEQTQKGAQERVQGQAQKGAQERAQEQAQEQTQIEAQGQAQKGAQERAREQAQKGAQERAREQAQKGAQERAREQAQKGAQERAREQAQKGAQERAREQAQKGAQERAREQAQKGAQERAQEQGREQTHIEAQGQAQKGAQEWARDRARDQGWEQTQIETQRQTQKGAQERAWEQGREQALTSGMAPRAWEQPISGIAEGVDAAGRSGGSRSPAPRDGGQSGGSGLGEPSAGYPPPGSRPLRGKSIATSPLGLGKSPTEPKPEAGGCGTPQAPAQEGSPDHPGAERALQDRMEASEPERRGRSRHLAKYKAQSFRDQRAFDLSFRPMSVRASDTSELPK

SEQ ID NO: 3432 - protein, 363 aa, Homo sapiens
  Payload ID: 759;
  Gene Symbol: ADPRHL2;
  Gene Name: ADP-ribosylhydrolase like 2;
  Uniprot ID:  Q9NX46;
  ENSP ID: ENSP00000362273
MAAAAMAAAAGGGAGAARSLSRFRGCLAGALLGDCVGSFYEAHDTVDLTSVLRHVQSLEPDPGTPGSERTEALYYTDDTAMARALVQSLLAKEAFDEVDMAHRFAQEYKKDPDRGYGAGVVTVFKKLLNPKCRDVFEPARAQFNGKGSYGNGGAMRVAGISLAYSSVQDVQKFARLSAQLTHASSLGYNGAILQALAVHLALQGESSSEHFLKQLLGHMEDLEGDAQSVLDARELGMEERPYSSRLKKIGELLDQASVTREEVVSELGNGIAAFESVPTAIYCFLRCMEPDPEIPSAFNSLQRTLIYSISLGGDTDTIATMAGAIAGAYYGMDQVPESWQQSCEGYEETDILAQSLHRVFQKS

SEQ ID NO: 3433 - protein, 327 aa, Homo sapiens
  Payload ID: 760;
  Gene Symbol: ART1;
  Gene Name: ADP-ribosyltransferase 1;
  Uniprot ID:  P52961;
  ENSP ID: ENSP00000250693
MQMPAMMSLLLVSVGLMEALQAQSHPITRRDLFSQEIQLDMALASFDDQYAGCAAAMTAALPDLNHTEFQANQVYADSWTLASSQWQERQARWPEWSLSPTRPSPPPLGFRDEHGVALLAYTANSPLHKEFNAAVREAGRSRAHYLHHFSFKTLHFLLTEALQLLGSGQRPPRCHQVFRGVHGLRFRPAGPRATVRLGGFASASLKHVAAQQFGEDTFFGIWTCLGAPIKGYSFFPGEEEVLIPPFETFQVINASRLAQGPARIYLRALGKHSTYNCEYIKDKKCKSGPCHLDNSAMGQSPLSAVWSLLLLLWFLVVRAFPDGPGLL

SEQ ID NO: 3434 - protein, 378 aa, Homo sapiens
  Payload ID: 761;
  Gene Symbol: ART3;
  Gene Name: ADP-ribosyltransferase 3;
  Uniprot ID:  Q13508;
  ENSP ID: ENSP00000304313
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGGLKTENCIENLEYFQPIYVYNPGEKNQKLEDHSEKNWKLEDHGEKNQKLEDHGVKILEPTQIPEDKSQGNINNPTPGPVPVPGPKSHPSASSGKLLLPQFGMVIILISVSAINLFVAL

SEQ ID NO: 3435 - protein, 367 aa, Homo sapiens
  Payload ID: 761;
  Gene Symbol: ART3;
  Gene Name: ADP-ribosyltransferase 3;
  Uniprot ID:  Q13508;
  ENSP ID: ENSP00000343843
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGGLKTENCIENLEYFQPIYVYNPGEKNQKLEDHSEKNWKLEDHGEKNQKLEDHGVKILEPTQIPAPGPVPVPGPKSHPSASSGKLLLPQFGMVIILISVSAINLFVAL

SEQ ID NO: 3436 - protein, 389 aa, Homo sapiens
  Payload ID: 761;
  Gene Symbol: ART3;
  Gene Name: ADP-ribosyltransferase 3;
  Uniprot ID:  Q13508;
  ENSP ID: ENSP00000348064
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGGLKTENCIENLEYFQPIYVYNPGEKNQKLEDHSEKNWKLEDHGEKNQKLEDHGVKILEPTQIPGMKIPEPFPLPEDKSQGNINNPTPGPVPVPGPKSHPSASSGKLLLPQFGMVIILISVSAINLFVAL

SEQ ID NO: 3437 - protein, 107 aa, Homo sapiens
  Payload ID: 761;
  Gene Symbol: ART3;
  Gene Name: ADP-ribosyltransferase 3;
  ENSP ID: ENSP00000421345
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQE

SEQ ID NO: 3438 - protein, 129 aa, Homo sapiens
  Payload ID: 761;
  Gene Symbol: ART3;
  Gene Name: ADP-ribosyltransferase 3;
  ENSP ID: ENSP00000421431
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDY

SEQ ID NO: 3439 - protein, 117 aa, Homo sapiens
  Payload ID: 761;
  Gene Symbol: ART3;
  Gene Name: ADP-ribosyltransferase 3;
  ENSP ID: ENSP00000422249
KTCSHYECAFLGGLKTENCIENLEYFQPIYVYNPGEKNQKLEDHSEKNWKLEDHGEKNQKLEDHGVKILEPTQIPGMKIPEPFPLPGIKMIQLNEKPEDKSQGNINNPTPGPVPVPG

SEQ ID NO: 3440 - protein, 201 aa, Homo sapiens
  Payload ID: 761;
  Gene Symbol: ART3;
  Gene Name: ADP-ribosyltransferase 3;
  ENSP ID: ENSP00000422287
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVL

SEQ ID NO: 3441 - protein, 174 aa, Homo sapiens
  Payload ID: 761;
  Gene Symbol: ART3;
  Gene Name: ADP-ribosyltransferase 3;
  ENSP ID: ENSP00000425327
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGG

SEQ ID NO: 3442 - protein, 314 aa, Homo sapiens
  Payload ID: 762;
  Gene Symbol: ART4;
  Gene Name: ADP-ribosyltransferase 4 (Dombrock blood group);
  Uniprot ID:  Q93070;
  ENSP ID: ENSP00000228936
MGPLINRCKKILLPTTVPPATMRIWLLGGLLPFLLLLSGLQRPTEGSEVAIKIDFDFAPGSFDDQYQGCSKQVMEKLTQGDYFTKDIEAQKNYFRMWQKAHLAWLNQGKVLPQNMTTTHAVAILFYTLNSNVHSDFTRAMASVARTPQQYERSFHFKYLHYYLTSAIQLLRKDSIMENGTLCYEVHYRTKDVHFNAYTGATIRFGQFLSTSLLKEEAQEFGNQTLFTIFTCLGAPVQYFSLKKEVLIPPYELFKVINMSYHPRGDWLQLRSTGNLSTYNCQLLKASSKKCIPDPIAIASLSFLTSVIIFSKSRV

SEQ ID NO: 3443 - protein, 273 aa, Homo sapiens
  Payload ID: 762;
  Gene Symbol: ART4;
  Gene Name: ADP-ribosyltransferase 4 (Dombrock blood group);
  ENSP ID: ENSP00000405689
PPATMRIWLLGGLLPFLLLLSGLQRPTEGSEVAIKIDFDFAPGSFDDQYQGCSKQVMEKLTQGDYFTKDIEAQKNYFRMWQKAHLAWLNQGKVLPQNMTTTHAVAILFYTLNSNVHSDFTRAMASVARTPQQYERSFHFKYLHYYLTSAIQLLRKDSIMENGTLCYEVHYRTKDVHFNAYTGATIRFGQFLSTSLLKEEAQEFGNQTLFTIFTCLGAPVQYFSLKKEVLIPPYELFKVINMSYHPRGDWLQLRSTGNLSTYNCQLLKGILYLN

SEQ ID NO: 3444 - protein, 65 aa, Homo sapiens
  Payload ID: 762;
  Gene Symbol: ART4;
  Gene Name: ADP-ribosyltransferase 4 (Dombrock blood group);
  ENSP ID: ENSP00000412735
PPATMRIWLLGGLLPFLLLLSGLQRPTEGSEVAIKIDFDFAPGSFDDQYQGCSKQLPARNASLIL

SEQ ID NO: 3445 - protein, 41 aa, Homo sapiens
  Payload ID: 762;
  Gene Symbol: ART4;
  Gene Name: ADP-ribosyltransferase 4 (Dombrock blood group);
  ENSP ID: ENSP00000442877
PPATMRIWLLGGLLPFLLLLSGLQRPTEGSELPARNASLIL

SEQ ID NO: 3446 - protein, 291 aa, Homo sapiens
  Payload ID: 763;
  Gene Symbol: ART5;
  Gene Name: ADP-ribosyltransferase 5;
  Uniprot ID:  Q96L15;
  ENSP ID: ENSP00000352992
MALAALMIALGSLGLHTWQAQAVPILPLGLAPDTFDDTYVGCAEEMEEKAAPLLKEEMAHHALLRESWEAAQETWEDKRRGLTLPPGFKAQNGIAIMVYTNSSNTLYWELNQAVRTGGGSRELYMRHFPFKALHFYLIRALQLLRGSGGCSRGPGEVVFRGVGSLRFEPKRLGDSVRLGQFASSSLDKAVAHRFGNATLFSLTTCFGAPIQAFSVFPKEREVLIPPHEVFLVTRFSQDGAQSLVTLWSYNQTCSHFNCAYLGGEKRRGCVSAPGALGTGDLHMTKRHLQQP

SEQ ID NO: 3447 - protein, 239 aa, Homo sapiens
  Payload ID: 763;
  Gene Symbol: ART5;
  Gene Name: ADP-ribosyltransferase 5;
  Uniprot ID:  Q96L15;
  ENSP ID: ENSP00000380257
MALAALMIALGSLGLHTWQAQAVPILPLGLAPDTFDDTYVGCAEEMEEKAAPLLKEEMAHHALLRESWEAAQETWEDKRRGLTLPPGFKAQNGIAIMVYTNSSNTLYWELNQAVRTGGGSRELYMRHFPFKALHFYLIRALQLLRGSGGCSRGPGEVVFRGVGSLRFEPKRLGDSVRLGQFASSSLDKAVAHRFGEKRRGCVSAPGVQLGSQSEGASSLPPWKTLLLAPGEFQLSGVGP

SEQ ID NO: 3448 - protein, 291 aa, Homo sapiens; identical to SEQ ID NO: 3446
  Payload ID: 763;
  Gene Symbol: ART5;
  Gene Name: ADP-ribosyltransferase 5;
  Uniprot ID:  Q96L15;
  ENSP ID: ENSP00000380258

SEQ ID NO: 3449 - protein, 264 aa, Homo sapiens
  Payload ID: 763;
  Gene Symbol: ART5;
  Gene Name: ADP-ribosyltransferase 5;
  ENSP ID: ENSP00000402737
  MOD_RES (1)..(1): Any amino acid
XEMEEKAAPLLKEEMAHHALLRESWEAAQETWEDKRRGLTLPPGFKAQNGIAIMVYTNSSNTLYWELNQAVRTGGGSRELYMRHFPFKALHFYLIRALQLLRGSGGCSRGPGEVVFRGVGSLRFEPKRLGDSVRLGQFASSSLDKAVAHRFGNATLFSLTTCFGAPIQAFSVFPKEREVLIPPHEVFLVTRFSQDGAQSLVTLWSYNQTCSHFNCAYLGGEKRRGCVSAPGVQLGSQSEGASSLPPWKTLLLAPGEFQLSGVGP

SEQ ID NO: 3450 - protein, 151 aa, Homo sapiens
  Payload ID: 763;
  Gene Symbol: ART5;
  Gene Name: ADP-ribosyltransferase 5;
  ENSP ID: ENSP00000413852
AVPILPLGLAPDTFDDTYVGCAEEMEEKAAPLLKEEMAHHALLRESWEAAQETWEDKRRGLTLPPGFKAQNGIAIMVYTNSSNTLYWELNQAAFSVFPKEREVLIPPHEVFLVTRFSQDGAQSLVTLWSYNQTCSHFNCAYLGGEKRRGCV

SEQ ID NO: 3451 - protein, 689 aa, Homo sapiens
  Payload ID: 764;
  Gene Symbol: ADRBK1;
  Gene Name: adrenergic, beta, receptor kinase 1;
  Uniprot ID:  P25098;
  ENSP ID: ENSP00000312262
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 3452 - protein, 408 aa, Homo sapiens
  Payload ID: 764;
  Gene Symbol: ADRBK1;
  Gene Name: adrenergic, beta, receptor kinase 1;
  ENSP ID: ENSP00000434126
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGSRCLCGVAPSPPRGWVGAPSPPVYSFPGAFLCRFLNVILKSEK

SEQ ID NO: 3453 - protein, 688 aa, Homo sapiens
  Payload ID: 765;
  Gene Symbol: ADRBK2;
  Gene Name: adrenergic, beta, receptor kinase 2;
  Uniprot ID:  P35626;
  ENSP ID: ENSP00000317578
MADLEAVLADVSYLMAMEKSKATPAARASKRIVLPEPSIRSVMQKYLAERNEITFDKIFNQKIGFLLFKDFCLNEINEAVPQVKFYEEIKEYEKLDNEEDRLCRSRQIYDAYIMKELLSCSHPFSKQAVEHVQSHLSKKQVTSTLFQPYIEEICESLRGDIFQKFMESDKFTRFCQWKNVELNIHLTMNEFSVHRIIGRGGFGEVYGCRKADTGKMYAMKCLDKKRIKMKQGETLALNERIMLSLVSTGDCPFIVCMTYAFHTPDKLCFILDLMNGGDLHYHLSQHGVFSEKEMRFYATEIILGLEHMHNRFVVYRDLKPANILLDEHGHARISDLGLACDFSKKKPHASVGTHGYMAPEVLQKGTAYDSSADWFSLGCMLFKLLRGHSPFRQHKTKDKHEIDRMTLTVNVELPDTFSPELKSLLEGLLQRDVSKRLGCHGGGSQEVKEHSFFKGVDWQHVYLQKYPPPLIPPRGEVNAADAFDIGSFDEEDTKGIKLLDCDQELYKNFPLVISERWQQEVTETVYEAVNADTDKIEARKRAKNKQLGHEEDYALGKDCIMHGYMLKLGNPFLTQWQRRYFYLFPNRLEWRGEGESRQNLLTMEQILSVEETQIKDKKCILFRIKGGKQFVLQCESDPEFVQWKKELNETFKEAQRLLRRAPKFLNKPRSGTVELPKPSLCHRNSNGL

SEQ ID NO: 3454 - protein, 45 aa, Homo sapiens
  Payload ID: 765;
  Gene Symbol: ADRBK2;
  Gene Name: adrenergic, beta, receptor kinase 2;
  ENSP ID: ENSP00000393688
TPAARASKRIVLPEPSIRSVMQKYLAERNEITFDKIFNQKIDKGI

SEQ ID NO: 3455 - protein, 387 aa, Homo sapiens
  Payload ID: 765;
  Gene Symbol: ADRBK2;
  Gene Name: adrenergic, beta, receptor kinase 2;
  ENSP ID: ENSP00000478925
MADLEAVLADVSYLMAMEKSKATPAARASKRIVLPEPSIRSVMQKYLAERNEITFDKIFNQKIGFLLFKDFCLNEINEAVPQVKFYEEIKEYEKLDNEEDRLCRSRQIYDAYIMKELLSCSHPFSKQAVEHVQSHLSKKQVTSTLFQPYIEEICESLRGDIFQKFMESDKFTRFCQWKNVELNIHLTMNEFSVHRIIGRGGFGEVYGCRKADTGKMYAMKCLDKKRIKMKQGETLALNERIMLSLVSTGDCPFIVCMTYAFHTPDKLCFILDLMNGGDLHYHLSQHGVFSEKEMRFYATEIILGLEHMHNRFVVYRDLKPANILLDEHGHARISDLGLACDFSKKKPHASVGTHGYMAPEVLQKGTAYDSSADWFSLGCMLFKLLRG

SEQ ID NO: 3456 - protein, 466 aa, Homo sapiens
  Payload ID: 766;
  Gene Symbol: ADRA1A;
  Gene Name: adrenoceptor alpha 1A;
  Uniprot ID:  P35348;
  ENSP ID: ENSP00000276393
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARVRSKSFLQVCCCVGPSTPSLDKNHQVPTIKVHTISLSENGEEV

SEQ ID NO: 3457 - protein, 455 aa, Homo sapiens
  Payload ID: 766;
  Gene Symbol: ADRA1A;
  Gene Name: adrenoceptor alpha 1A;
  Uniprot ID:  P35348;
  ENSP ID: ENSP00000346557
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARRGMDCRYFTKNCREHIKHVNFMMPPWRKGSEC

SEQ ID NO: 3458 - protein, 342 aa, Homo sapiens
  Payload ID: 766;
  Gene Symbol: ADRA1A;
  Gene Name: adrenoceptor alpha 1A;
  Uniprot ID:  P35348;
  ENSP ID: ENSP00000369946
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIDEETEAQEGKNDSPSFKQPVHHAAVLGLEVMEKENLEGVSRKDTCGVW

SEQ ID NO: 3459 - protein, 466 aa, Homo sapiens; identical to SEQ ID NO: 3456
  Payload ID: 766;
  Gene Symbol: ADRA1A;
  Gene Name: adrenoceptor alpha 1A;
  Uniprot ID:  P35348;
  ENSP ID: ENSP00000369947

SEQ ID NO: 3460 - protein, 429 aa, Homo sapiens
  Payload ID: 766;
  Gene Symbol: ADRA1A;
  Gene Name: adrenoceptor alpha 1A;
  Uniprot ID:  P35348;
  ENSP ID: ENSP00000369956
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARGHTPMT

SEQ ID NO: 3461 - protein, 475 aa, Homo sapiens
  Payload ID: 766;
  Gene Symbol: ADRA1A;
  Gene Name: adrenoceptor alpha 1A;
  Uniprot ID:  P35348;
  ENSP ID: ENSP00000369960
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARTKSRSVTRLECSGMILAHCNLRLPGSRDSPASASQAAGTTGMCHQADATRPS

SEQ ID NO: 3462 - protein, 324 aa, Homo sapiens
  Payload ID: 766;
  Gene Symbol: ADRA1A;
  Gene Name: adrenoceptor alpha 1A;
  Uniprot ID:  P35348;
  ENSP ID: ENSP00000430414
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGTYILKYDVLFWRKGLSVCTRLRERKEIKN

SEQ ID NO: 3463 - protein, 427 aa, Homo sapiens
  Payload ID: 766;
  Gene Symbol: ADRA1A;
  Gene Name: adrenoceptor alpha 1A;
  ENSP ID: ENSP00000430793
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARSSGF

SEQ ID NO: 3464 - protein, 324 aa, Homo sapiens; identical to SEQ ID NO: 3462
  Payload ID: 766;
  Gene Symbol: ADRA1A;
  Gene Name: adrenoceptor alpha 1A;
  Uniprot ID:  P35348;
  ENSP ID: ENSP00000431073

SEQ ID NO: 3465 - protein, 520 aa, Homo sapiens
  Payload ID: 767;
  Gene Symbol: ADRA1B;
  Gene Name: adrenoceptor alpha 1B;
  Uniprot ID:  P35368;
  ENSP ID: ENSP00000306662
MNPDLDTGHNTSAPAHWGELKNANFTGPNQTSSNSTLPQLDITRAISVGLVLGAFILFAIVGNILVILSVACNRHLRTPTNYFIVNLAMADLLLSFTVLPFSAALEVLGYWVLGRIFCDIWAAVDVLCCTASILSLCAISIDRYIGVRYSLQYPTLVTRRKAILALLSVWVLSTVISIGPLLGWKEPAPNDDKECGVTEEPFYALFSSLGSFYIPLAVILVMYCRVYIVAKRTTKNLEAGVMKEMSNSKELTLRIHSKNFHEDTLSSTKAKGHNPRSSIAVKLFKFSREKKAAKTLGIVVGMFILCWLPFFIALPLGSLFSTLKPPDAVFKVVFWLGYFNSCLNPIIYPCSSKEFKRAFVRILGCQCRGRGRRRRRRRRRLGGCAYTYRPWTRGGSLERSQSRKDSLDDSGSCLSGSQRTLPSASPSPGYLGRGAPPPVELCAFPEWKAPGALLSLPAPEPPGRRGRHDSGPLFTFKLLTEPESPGTDGGASNGGCEAAADVANGQPGFKSNMPLAPGQF

SEQ ID NO: 3466 - protein, 572 aa, Homo sapiens
  Payload ID: 768;
  Gene Symbol: ADRA1D;
  Gene Name: adrenoceptor alpha 1D;
  Uniprot ID:  P25100;
  ENSP ID: ENSP00000368766
MTFRDLLSVSFEGPRPDSSAGGSSAGGGGGSAGGAAPSEGPAVGGVPGGAGGGGGVVGAGSGEDNRSSAGEPGSAGAGGDVNGTAAVGGLVVSAQGVGVGVFLAAFILMAVAGNLLVILSVACNRHLQTVTNYFIVNLAVADLLLSATVLPFSATMEVLGFWAFGRAFCDVWAAVDVLCCTASILSLCTISVDRYVGVRHSLKYPAIMTERKAAAILALLWVVALVVSVGPLLGWKEPVPPDERFCGITEEAGYAVFSSVCSFYLPMAVIVVMYCRVYVVARSTTRSLEAGVKRERGKASEVVLRIHCRGAATGADGAHGMRSAKGHTFRSSLSVRLLKFSREKKAAKTLAIVVGVFVLCWFPFFFVLPLGSLFPQLKPSEGVFKVIFWLGYFNSCVNPLIYPCSSREFKRAFLRLLRCQCRRRRRRRPLWRVYGHHWRASTSGLRQDCAPSSGDAPPGAPLALTALPDPDPEPPGTPEMQAPVASRRKPPSAFREWRLLGPFRRPTTQLRAKVSSLSHKIRAGGAQRAEAACAQRSEVEAVSLGVPHEVAEGATCQAYELADYSNLRETDI

SEQ ID NO: 3467 - protein, 465 aa, Homo sapiens
  Payload ID: 769;
  Gene Symbol: ADRA2A;
  Gene Name: adrenoceptor alpha 2A;
  Uniprot ID:  P08913;
  ENSP ID: ENSP00000280155
MFRQEQPLAEGSFAPMGSLQPDAGNASWNGTEAPGGGARATPYSLQVTLTLVCLAGLLMLLTVFGNVLVIIAVFTSRALKAPQNLFLVSLASADILVATLVIPFSLANEVMGYWYFGKAWCEIYLALDVLFCTSSIVHLCAISLDRYWSITQAIEYNLKRTPRRIKAIIITVWVISAVISFPPLISIEKKGGGGGPQPAEPRCEINDQKWYVISSCIGSFFAPCLIMILVYVRIYQIAKRRTRVPPSRRGPDAVAAPPGGTERRPNGLGPERSAGPGGAEAEPLPTQLNGAPGEPAPAGPRDTDALDLEESSSSDHAERPPGPRRPERGPRGKGKARASQVKPGDSLPRRGPGATGIGTPAAGPGEERVGAAKASRWRGRQNREKRFTFVLAVVIGVFVVCWFPFFFTYTLTAVGCSVPRTLFKFFFWFGYCNSSLNPVIYTIFNHDFRRAFKKILCRGDRKRIV

SEQ ID NO: 3468 - protein, 450 aa, Homo sapiens
  Payload ID: 770;
  Gene Symbol: ADRA2B;
  Gene Name: adrenoceptor alpha 2B;
  ENSP ID: ENSP00000480573
MDHQDPYSVQATAAIAAAITFLILFTIFGNALVILAVLTSRSLRAPQNLFLVSLAAADILVATLIIPFSLANELLGYWYFRRTWCEVYLALDVLFCTSSIVHLCAISLDRYWAVSRALEYNSKRTPRRIKCIILTVWLIAAVISLPPLIYKGDQGPQPRGRPQCKLNQEAWYILASSIGSFFAPCLIMILVYLRIYLIAKRSNRRGPRAKGGPGQGESKQPRPDHGGALASAKLPALASVASAREVNGHSKSTGEKEEGETPEDTGTRALPPSWAALPNSGQGQKEGVCGASPEDEAEEEEEEEEEEEECEPQAVPVSPASACSPPLQQPQGSRVLATLRGQVLLGRGVGAIGGQWWRRRAQLTREKRFTFVLAVVIGVFVLCWFPFFFSYSLGAICPKHCKVPHGLFQFFFWIGYCNSSLNPVIYTIFNQDFRRAFRRILCRPWTQTAW

SEQ ID NO: 3469 - protein, 462 aa, Homo sapiens
  Payload ID: 771;
  Gene Symbol: ADRA2C;
  Gene Name: adrenoceptor alpha 2C;
  Uniprot ID:  P18825;
  ENSP ID: ENSP00000386069
MASPALAAALAVAAAAGPNASGAGERGSGGVANASGASWGPPRGQYSAGAVAGLAAVVGFLIVFTVVGNVLVVIAVLTSRALRAPQNLFLVSLASADILVATLVMPFSLANELMAYWYFGQVWCGVYLALDVLFCTSSIVHLCAISLDRYWSVTQAVEYNLKRTPRRVKATIVAVWLISAVISFPPLVSLYRQPDGAAYPQCGLNDETWYILSSCIGSFFAPCLIMGLVYARIYRVAKLRTRTLSEKRAPVGPDGASPTTENGLGAAAGAGENGHCAPPPADVEPDESSAAAERRRRRGALRRGGRRRAGAEGGAGGADGQGAGPGAAESGALTASRSPGPGGRLSRASSRSVEFFLSRRRRARSSVCRRKVAQAREKRFTFVLAVVMGVFVLCWFPFFFSYSLYGICREACQVPGPLFKFFFWIGYCNSSLNPVIYTVFNQDFRRSFKHILFRRRRRGFRQ

SEQ ID NO: 3470 - protein, 374 aa, Homo sapiens
  Payload ID: 771;
  Gene Symbol: ADRA2C;
  Gene Name: adrenoceptor alpha 2C;
  ENSP ID: ENSP00000426268
MASPALAAALAVAAAAGPNASGAGERGSGGVANASGASWGPPRGQYSAGAVAGLAAVVGFLIVFTVVGNVLVVIAVLTSRALRAPQNLFLVSLASADILVATLVMPFSLANELMAYWYFGQVWCGVYLALDVLFCTSSIVHLCAISLDRYWSVTQAVEYNLKRTPRRVKATIVAVWLISAVISFPPLVSLYRQPDGAAYPQCGLNDETWYILSSCIGSFFAPCLIMGLVYARIYRVAKLRTRTLSEKRAPVGPDGASPTTENGLGAAAGAGENGHCAPPPADVEPDESSAAAERRRRRGALRRGGRRRAGAEGGAGGADGQGAGPGAAESGALTASREWGGERGRPLCLPPSARGCFWGSLPGSSSGSPAEVWL

SEQ ID NO: 3471 - protein, 477 aa, Homo sapiens
  Payload ID: 772;
  Gene Symbol: ADRB1;
  Gene Name: adrenoceptor beta 1;
  Uniprot ID:  P08588;
  ENSP ID: ENSP00000358301
MGAGVLVLGASEPGNLSSAAPLPDGAATAARLLVPASPPASLLPPASESPEPLSQQWTAGMGLLMALIVLLIVAGNVLVIVAIAKTPRLQTLTNLFIMSLASADLVMGLLVVPFGATIVVWGRWEYGSFFCELWTSVDVLCVTASIETLCVIALDRYLAITSPFRYQSLLTRARARGLVCTVWAISALVSFLPILMHWWRAESDEARRCYNDPKCCDFVTNRAYAIASSVVSFYVPLCIMAFVYLRVFREAQKQVKKIDSCERRFLGGPARPPSPSPSPVPAPAPPPGPPRPAAAAATAPLANGRAGKRRPSRLVALREQKALKTLGIIMGVFTLCWLPFFLANVVKAFHRELVPDRLFVFFNWLGYANSAFNPIIYCRSPDFRKAFQGLLCCARRAARRRHATHGDRPRASGCLARPGPPPSPGAASDDDDDDVVGATPPARLLEPWAGCNGGAAADSDSSLDEPCRPGFASESKV

SEQ ID NO: 3472 - protein, 413 aa, Homo sapiens [sequence omitted]

SEQ ID NO: 3473 - protein, 408 aa, Homo sapiens
  Payload ID: 774;
  Gene Symbol: ADRB3;
  Gene Name: adrenoceptor beta 3;
  Uniprot ID:  P13945;
  ENSP ID: ENSP00000343782
MAPWPHENSSLAPWPDLPTLAPNTANTSGLPGVPWEAALAGALLALAVLATVGGNLLVIVAIAWTPRLQTMTNVFVTSLAAADLVMGLLVVPPAATLALTGHWPLGATGCELWTSVDVLCVTASIETLCALAVDRYLAVTNPLRYGALVTKRCARTAVVLVWVVSAAVSFAPIMSQWWRVGADAEAQRCHSNPRCCAFASNMPYVLLSSSVSFYLPLLVMLFVYARVFVVATRQLRLLRGELGRFPPEESPPAPSRSLAPAPVGTCAPPEGVPACGRRPARLLPLREHRALCTLGLIMGTFTLCWLPFFLANVLRALGGPSLVPGPAFLALNWLGYANSAFNPLIYCRSPDFRSAFRRLLCRCGRRLPPEPCAAARPALFPSGVPAARSSPAQPRLCQRLDGASWGVS

SEQ ID NO: 3474 - protein, 408 aa, Homo sapiens; identical to SEQ ID NO: 3473
  Payload ID: 774;
  Gene Symbol: ADRB3;
  Gene Name: adrenoceptor beta 3;
  Uniprot ID:  P13945;
  ENSP ID: ENSP00000480325

SEQ ID NO: 3475 - protein, 541 aa, Homo sapiens
  Payload ID: 775;
  Gene Symbol: ACD;
  Gene Name: adrenocortical dysplasia homolog (mouse);
  Uniprot ID:  Q96AP0;
  ENSP ID: ENSP00000219251
MPGRCQSDAAMRVNGPASRAPAGWTSGSLHTGPRAGRPRAQARGVRGRGLLLRPRPAKELPLPRKGGAWAPAGNPGPLHPLGVAVGMAGSGRLVLRPWIRELILGSETPSSPRAGQLLEDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGTPALPGHMSSEESGTSISLLPALSLAAPDPGQRSSSQPSPAICSAPATLTPRSPHASRTPSSPLQSCTPSLSPRSHVPSPHQALVTRPQKPSLEFKEFVGLPCKNRPPFPRTGATRGAQEPCSVWEPPKRHRDGSAFQYEYEPPCTSLCARVQAVRLPPQLMAWALHFLMDAQPGSEPTPM

SEQ ID NO: 3476 - protein, 544 aa, Homo sapiens
  Payload ID: 775;
  Gene Symbol: ACD;
  Gene Name: adrenocortical dysplasia homolog (mouse);
  Uniprot ID:  Q96AP0;
  ENSP ID: ENSP00000377496
MPGRCQSDAAMRVNGPASRAPAGWTSGSLHTGPRAGRPRAQARGVRGRGLLLRPRPAKELPLPRKGGAWAPAGNPGPLHPLGVAVGMAGSGRLVLRPWIRELILGSETPSSPRAGQLLEVLQDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGTPALPGHMSSEESGTSISLLPALSLAAPDPGQRSSSQPSPAICSAPATLTPRSPHASRTPSSPLQSCTPSLSPRSHVPSPHQALVTRPQKPSLEFKEFVGLPCKNRPPFPRTGATRGAQEPCSVWEPPKRHRDGSAFQYEYEPPCTSLCARVQAVRLPPQLMAWALHFLMDAQPGSEPTPM

SEQ ID NO: 3477 - protein, 182 aa, Homo sapiens
  Payload ID: 775;
  Gene Symbol: ACD;
  Gene Name: adrenocortical dysplasia homolog (mouse);
  ENSP ID: ENSP00000473313
  MOD_RES (1)..(1): Any amino acid
XEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGPELPGEPRSPALSGNPQRGIVMVLPSSMSMSHPARPSVLGSKLSGFLPSSWPGPCTF

SEQ ID NO: 3478 - protein, 16 aa, Homo sapiens
  Payload ID: 775;
  Gene Symbol: ACD;
  Gene Name: adrenocortical dysplasia homolog (mouse);
  ENSP ID: ENSP00000473595
SVRCLVTREALDTSDW

SEQ ID NO: 3479 - protein, 442 aa, Homo sapiens
  Payload ID: 775;
  Gene Symbol: ACD;
  Gene Name: adrenocortical dysplasia homolog (mouse);
  ENSP ID: ENSP00000473679
MAGSGRLVLRPWIRELILGSETPSSPRAGQLLEDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGTPALPGHMSSEESGTSISLLPALSLAAPDPGQRSSSQPSPAICSAPATLTPRSPHASRTPSSPLQSCTPSLSPRSHVPSPHQALVTRPQKPSLEFKEFVGLPCKNRPPFPRTGATRGAQEPCSVWYEYEPPCTSLCARVQAVRLPPQLMAWALHFLMDAQPGSEPTPM

SEQ ID NO: 3480 - protein, 458 aa, Homo sapiens
  Payload ID: 775;
  Gene Symbol: ACD;
  Gene Name: adrenocortical dysplasia homolog (mouse);
  ENSP ID: ENSP00000478084
MAGSGRLVLRPWIRELILGSETPSSPRAGQLLEVLQDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGTPALPGHMSSEESGTSISLLPALSLAAPDPGQRSSSQPSPAICSAPATLTPRSPHASRTPSSPLQSCTPSLSPRSHVPSPHQALVTRPQKPSLEFKEFVGLPCKNRPPFPRTGATRGAQEPCSVWEPPKRHRDGSAFQYEYEPPCTSLCARVQAVRLPPQLMAWALHFLMDAQPGSEPTPM

SEQ ID NO: 3481 - protein, 544 aa, Homo sapiens; identical to SEQ ID NO: 3476
  Payload ID: 775;
  Gene Symbol: ACD;
  Gene Name: adrenocortical dysplasia homolog (mouse);
  Uniprot ID:  Q96AP0;
  ENSP ID: ENSP00000483117

SEQ ID NO: 3482 - protein, 185 aa, Homo sapiens
  Payload ID: 776;
  Gene Symbol: ADM;
  Gene Name: adrenomedullin;
  Uniprot ID:  P35318;
  ENSP ID: ENSP00000278175
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 3483 - protein, 138 aa, Homo sapiens
  Payload ID: 776;
  Gene Symbol: ADM;
  Gene Name: adrenomedullin;
  ENSP ID: ENSP00000431438
MSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 3484 - protein, 83 aa, Homo sapiens
  Payload ID: 776;
  Gene Symbol: ADM;
  Gene Name: adrenomedullin;
  ENSP ID: ENSP00000433062
MKLVSVALMYLGSLAFLGADTARLDVASEFRKKWNKWALSRGKRELRMSSSYPTGLADVKAGPAQTLIRPQDMKGASRSPEDR

SEQ ID NO: 3485 - protein, 139 aa, Homo sapiens
  Payload ID: 776;
  Gene Symbol: ADM;
  Gene Name: adrenomedullin;
  ENSP ID: ENSP00000434354
MKLVSVALMYLGSLAFLGADTARLDVASEFRKKWNKWALSRGKRELRMSSSYPTGLADVKAGPAQTLIRPQDMKGASRSPEDSCLSSPSPRPQQSGCRPHPSQALPPEHEQLPGPPELWLPLRDVHGAEAGTPDLPVHR

SEQ ID NO: 3486 - protein, 83 aa, Homo sapiens; identical to SEQ ID NO: 3484
  Payload ID: 776;
  Gene Symbol: ADM;
  Gene Name: adrenomedullin;
  ENSP ID: ENSP00000434749

SEQ ID NO: 3487 - protein, 185 aa, Homo sapiens; identical to SEQ ID NO: 3482
  Payload ID: 776;
  Gene Symbol: ADM;
  Gene Name: adrenomedullin;
  Uniprot ID:  P35318;
  ENSP ID: ENSP00000435124

SEQ ID NO: 3488 - protein, 185 aa, Homo sapiens; identical to SEQ ID NO: 3482
  Payload ID: 776;
  Gene Symbol: ADM;
  Gene Name: adrenomedullin;
  Uniprot ID:  P35318;
  ENSP ID: ENSP00000436607

SEQ ID NO: 3489 - protein, 117 aa, Homo sapiens
  Payload ID: 776;
  Gene Symbol: ADM;
  Gene Name: adrenomedullin;
  ENSP ID: ENSP00000436837
MGSQVAFLPPPPARSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 3490 - protein, 148 aa, Homo sapiens
  Payload ID: 777;
  Gene Symbol: ADM2;
  Gene Name: adrenomedullin 2;
  Uniprot ID:  Q7Z4H4;
  ENSP ID: ENSP00000379086
MARIPTAALGCISLLCLQLPGSLSRSLGGDPRPVKPREPPARSPSSSLQPRHPAPRPVVWKLHRALQAQRGAGLAPVMGQPLRDGGRQHSGPRRHSGPRRTQAQLLRVGCVLGTCQVQNLSHRLWQLMGPAGRQDSAPVDPSSPHSYG

SEQ ID NO: 3491 - protein, 148 aa, Homo sapiens; identical to SEQ ID NO: 3490
  Payload ID: 777;
  Gene Symbol: ADM2;
  Gene Name: adrenomedullin 2;
  Uniprot ID:  Q7Z4H4;
  ENSP ID: ENSP00000379087

SEQ ID NO: 3492 - protein, 153 aa, Homo sapiens
  Payload ID: 778;
  Gene Symbol: ADM5;
  Gene Name: adrenomedullin 5 (putative);
  Uniprot ID:  C9JUS6;
  ENSP ID: ENSP00000393631
MTIHILILLLLLAFSAQGDLDTAARRGQHQVPQHRGHVCYLGVCRTHRLAEIIYWIRCLHQGALGEGQPRAPGPLQLWAPPVARGGSPARFPGFRPAARGLAQCPARWVTSGTARPLLGFSLPICMLELLLHISSPLTPAPETVFPSPSPGCD

SEQ ID NO: 3493 - protein, 347 aa, Homo sapiens
  Payload ID: 779;
  Gene Symbol: AGER;
  Gene Name: advanced glycosylation end product-specific receptor;
  Uniprot ID:  Q15109;
  ENSP ID: ENSP00000364195
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGEGFDKVREAEDSPQHM

SEQ ID NO: 3494 - protein, 233 aa, Homo sapiens
  Payload ID: 779;
  Gene Symbol: AGER;
  Gene Name: advanced glycosylation end product-specific receptor;
  ENSP ID: ENSP00000364196
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRH

SEQ ID NO: 3495 - protein, 133 aa, Homo sapiens
  Payload ID: 779;
  Gene Symbol: AGER;
  Gene Name: advanced glycosylation end product-specific receptor;
  ENSP ID: ENSP00000364206
MKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 3496 - protein, 342 aa, Homo sapiens
  Payload ID: 779;
  Gene Symbol: AGER;
  Gene Name: advanced glycosylation end product-specific receptor;
  Uniprot ID:  Q15109;
  ENSP ID: ENSP00000364208
MAAGTAVGAWVLVLSLWGAVVGAQNITARIGEPLVLKCKGAPKKPPQRLEWKLGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDVSDLERGAGRTRRGGANCRLCGRIRAGNSSPGPGDPGRPGDSRPAHWGHLVAKAATPRRGEEGPRKPGGRGGACRTESVGGT

SEQ ID NO: 3497 - protein, 420 aa, Homo sapiens
  Payload ID: 779;
  Gene Symbol: AGER;
  Gene Name: advanced glycosylation end product-specific receptor;
  Uniprot ID:  Q15109;
  ENSP ID: ENSP00000364210
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 3498 - protein, 294 aa, Homo sapiens
  Payload ID: 779;
  Gene Symbol: AGER;
  Gene Name: advanced glycosylation end product-specific receptor;
  ENSP ID: ENSP00000364211
MNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIGSVGGSGLGTLALALGILGGLGTAALLIGVILWQRRQRRGEERKAPENQEEEEERAELNQSEEPEAGESSTGGP

SEQ ID NO: 3499 - protein, 404 aa, Homo sapiens
  Payload ID: 779;
  Gene Symbol: AGER;
  Gene Name: advanced glycosylation end product-specific receptor;
  Uniprot ID:  Q15109;
  ENSP ID: ENSP00000364217
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 3500 - protein, 347 aa, Homo sapiens; identical to SEQ ID NO: 3493
  Payload ID: 779;
  Gene Symbol: AGER;
  Gene Name: advanced glycosylation end product-specific receptor;
  Uniprot ID:  Q15109;
  ENSP ID: ENSP00000372762

SEQ ID NO: 3501 - protein, 342 aa, Homo sapiens; identical to SEQ ID NO: 3496
  Payload ID: 779;
  Gene Symbol: AGER;
  Gene Name: advanced glycosylation end product-specific receptor;
  Uniprot ID:  Q15109;
  ENSP ID: ENSP00000372766

SEQ ID NO: 3502 - protein, 342 aa, Homo sapiens; identical to SEQ ID NO: 3496
  Payload ID: 779;
  Gene Symbol: AGER;
  Gene Name: advanced glycosylation end product-specific receptor;
  Uniprot ID:  Q15109;
  ENSP ID: ENSP00000387853

SEQ ID NO: 3503 - protein, 363 aa, Homo sapiens
  Payload ID: 779;
  Gene Symbol: AGER;
  Gene Name: advanced glycosylation end product-specific receptor;
  Uniprot ID:  Q15109;
  ENSP ID: ENSP00000387887
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGEGFDKVREAEDSPQHM

SEQ ID NO: 3504 - protein, 234 aa, Homo sapiens
  Payload ID: 779;
  Gene Symbol: AGER;
  Gene Name: advanced glycosylation end product-specific receptor;
  ENSP ID: ENSP00000388041
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRSLRTFTITASDWIFPPSEIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALR

SEQ ID NO: 3505 - protein, 342 aa, Homo sapiens; identical to SEQ ID NO: 3496
  Payload ID: 779;
  Gene Symbol: AGER;
  Gene Name: advanced glycosylation end product-specific receptor;
  Uniprot ID:  Q15109;
  ENSP ID: ENSP00000388462

SEQ ID NO: 3506 - protein, 234 aa, Homo sapiens
  Payload ID: 779;
  Gene Symbol: AGER;
  Gene Name: advanced glycosylation end product-specific receptor;
  ENSP ID: ENSP00000391024
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRSLRTFTITASDWIFPPSEIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALR

SEQ ID NO: 3507 - protein, 342 aa, Homo sapiens; identical to SEQ ID NO: 3496
  Payload ID: 779;
  Gene Symbol: AGER;
  Gene Name: advanced glycosylation end product-specific receptor;
  Uniprot ID:  Q15109;
  ENSP ID: ENSP00000391743

SEQ ID NO: 3508 - protein, 342 aa, Homo sapiens
  Payload ID: 779;
  Gene Symbol: AGER;
  Gene Name: advanced glycosylation end product-specific receptor;
  ENSP ID: ENSP00000391970
MAAGTAVGAWVLVLSLWGAVVGAQNITARIGEPLVLKCKGAPKKPPQRLEWKLGGGPWDSVARVLPNSSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDVSDLERGAGRTRRGGANCRLCGRIRAGNSSPGPGDPGRPGDSRPAHWGHLVAKAATPRRGEEGPRKPGGRGGACRTESVGGT

SEQ ID NO: 3509 - protein, 233 aa, Homo sapiens; identical to SEQ ID NO: 3494
  Payload ID: 779;
  Gene Symbol: AGER;
  Gene Name: advanced glycosylation end product-specific receptor;
  ENSP ID: ENSP00000394516

SEQ ID NO: 3510 - protein, 234 aa, Homo sapiens; identical to SEQ ID NO: 3506
  Payload ID: 779;
  Gene Symbol: AGER;
  Gene Name: advanced glycosylation end product-specific receptor;
  ENSP ID: ENSP00000395578

SEQ ID NO: 3511 - protein, 404 aa, Homo sapiens; identical to SEQ ID NO: 3499
  Payload ID: 779;
  Gene Symbol: AGER;
  Gene Name: advanced glycosylation end product-specific receptor;
  Uniprot ID:  Q15109;
  ENSP ID: ENSP00000395812

SEQ ID NO: 3512 - protein, 404 aa, Homo sapiens; identical to SEQ ID NO: 3499
  Payload ID: 779;
  Gene Symbol: AGER;
  Gene Name: advanced glycosylation end product-specific receptor;
  Uniprot ID:  Q15109;
  ENSP ID: ENSP00000397227

SEQ ID NO: 3513 - protein, 233 aa, Homo sapiens
  Payload ID: 779;
  Gene Symbol: AGER;
  Gene Name: advanced glycosylation end product-specific receptor;
  ENSP ID: ENSP00000397350
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRH

SEQ ID NO: 3514 - protein, 342 aa, Homo sapiens; identical to SEQ ID NO: 3508
  Payload ID: 779;
  Gene Symbol: AGER;
  Gene Name: advanced glycosylation end product-specific receptor;
  ENSP ID: ENSP00000397777

SEQ ID NO: 3515 - protein, 234 aa, Homo sapiens; identical to SEQ ID NO: 3506
  Payload ID: 779;
  Gene Symbol: AGER;
  Gene Name: advanced glycosylation end product-specific receptor;
  ENSP ID: ENSP00000398466

SEQ ID NO: 3516 - protein, 233 aa, Homo sapiens; identical to SEQ ID NO: 3494
  Payload ID: 779;
  Gene Symbol: AGER;
  Gene Name: advanced glycosylation end product-specific receptor;
  ENSP ID: ENSP00000399134

SEQ ID NO: 3517 - protein, 347 aa, Homo sapiens; identical to SEQ ID NO: 3493
  Payload ID: 779;
  Gene Symbol: AGER;
  Gene Name: advanced glycosylation end product-specific receptor;
  Uniprot ID:  Q15109;
  ENSP ID: ENSP00000399686

SEQ ID NO: 3518 - protein, 347 aa, Homo sapiens; identical to SEQ ID NO: 3493
  Payload ID: 779;
  Gene Symbol: AGER;
  Gene Name: advanced glycosylation end product-specific receptor;
  Uniprot ID:  Q15109;
  ENSP ID: ENSP00000400667

SEQ ID NO: 3519 - protein, 404 aa, Homo sapiens; identical to SEQ ID NO: 3499
  Payload ID: 779;
  Gene Symbol: AGER;
  Gene Name: advanced glycosylation end product-specific receptor;
  Uniprot ID:  Q15109;
  ENSP ID: ENSP00000401068

SEQ ID NO: 3520 - protein, 234 aa, Homo sapiens; identical to SEQ ID NO: 3506
  Payload ID: 779;
  Gene Symbol: AGER;
  Gene Name: advanced glycosylation end product-specific receptor;
  ENSP ID: ENSP00000401896

SEQ ID NO: 3521 - protein, 347 aa, Homo sapiens
  Payload ID: 779;
  Gene Symbol: AGER;
  Gene Name: advanced glycosylation end product-specific receptor;
  ENSP ID: ENSP00000403322
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGEGFDKVREAEDSPQHM

SEQ ID NO: 3522 - protein, 347 aa, Homo sapiens; identical to SEQ ID NO: 3521
  Payload ID: 779;
  Gene Symbol: AGER;
  Gene Name: advanced glycosylation end product-specific receptor;
  ENSP ID: ENSP00000407467

SEQ ID NO: 3523 - protein, 404 aa, Homo sapiens; identical to SEQ ID NO: 3499
  Payload ID: 779;
  Gene Symbol: AGER;
  Gene Name: advanced glycosylation end product-specific receptor;
  Uniprot ID:  Q15109;
  ENSP ID: ENSP00000409457

SEQ ID NO: 3524 - protein, 233 aa, Homo sapiens; identical to SEQ ID NO: 3494
  Payload ID: 779;
  Gene Symbol: AGER;
  Gene Name: advanced glycosylation end product-specific receptor;
  ENSP ID: ENSP00000410918

SEQ ID NO: 3525 - protein, 233 aa, Homo sapiens; identical to SEQ ID NO: 3494
  Payload ID: 779;
  Gene Symbol: AGER;
  Gene Name: advanced glycosylation end product-specific receptor;
  ENSP ID: ENSP00000411203

SEQ ID NO: 3526 - protein, 233 aa, Homo sapiens; identical to SEQ ID NO: 3513
  Payload ID: 779;
  Gene Symbol: AGER;
  Gene Name: advanced glycosylation end product-specific receptor;
  ENSP ID: ENSP00000411652

SEQ ID NO: 3527 - protein, 234 aa, Homo sapiens; identical to SEQ ID NO: 3506
  Payload ID: 779;
  Gene Symbol: AGER;
  Gene Name: advanced glycosylation end product-specific receptor;
  ENSP ID: ENSP00000412576

SEQ ID NO: 3528 - protein, 347 aa, Homo sapiens; identical to SEQ ID NO: 3493
  Payload ID: 779;
  Gene Symbol: AGER;
  Gene Name: advanced glycosylation end product-specific receptor;
  Uniprot ID:  Q15109;
  ENSP ID: ENSP00000413391

SEQ ID NO: 3529 - protein, 404 aa, Homo sapiens [sequence omitted]

SEQ ID NO: 3530 - protein, 234 aa, Homo sapiens; identical to SEQ ID NO: 3504
  Payload ID: 779;
  Gene Symbol: AGER;
  Gene Name: advanced glycosylation end product-specific receptor;
  ENSP ID: ENSP00000415780

SEQ ID NO: 3531 - protein, 404 aa, Homo sapiens [sequence omitted]

SEQ ID NO: 3532 - protein, 128 aa, Homo sapiens
  Payload ID: 779;
  Gene Symbol: AGER;
  Gene Name: advanced glycosylation end product-specific receptor;
  ENSP ID: ENSP00000445389
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQFENLHNYSL

SEQ ID NO: 3533 - protein, 133 aa, Homo sapiens; identical to SEQ ID NO: 3495
  Payload ID: 779;
  Gene Symbol: AGER;
  Gene Name: advanced glycosylation end product-specific receptor;
  ENSP ID: ENSP00000446495

SEQ ID NO: 3534 - protein, 133 aa, Homo sapiens; identical to SEQ ID NO: 3495
  Payload ID: 779;
  Gene Symbol: AGER;
  Gene Name: advanced glycosylation end product-specific receptor;
  ENSP ID: ENSP00000446533

SEQ ID NO: 3535 - protein, 128 aa, Homo sapiens; identical to SEQ ID NO: 3532
  Payload ID: 779;
  Gene Symbol: AGER;
  Gene Name: advanced glycosylation end product-specific receptor;
  ENSP ID: ENSP00000446582

SEQ ID NO: 3536 - protein, 363 aa, Homo sapiens
  Payload ID: 779;
  Gene Symbol: AGER;
  Gene Name: advanced glycosylation end product-specific receptor;
  ENSP ID: ENSP00000446660
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGEGFDKVREAEDSPQHM

SEQ ID NO: 3537 - protein, 420 aa, Homo sapiens
  Payload ID: 779;
  Gene Symbol: AGER;
  Gene Name: advanced glycosylation end product-specific receptor;
  ENSP ID: ENSP00000446682
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 3538 - protein, 133 aa, Homo sapiens; identical to SEQ ID NO: 3495
  Payload ID: 779;
  Gene Symbol: AGER;
  Gene Name: advanced glycosylation end product-specific receptor;
  ENSP ID: ENSP00000446692

SEQ ID NO: 3539 - protein, 363 aa, Homo sapiens; identical to SEQ ID NO: 3503
  Payload ID: 779;
  Gene Symbol: AGER;
  Gene Name: advanced glycosylation end product-specific receptor;
  Uniprot ID:  Q15109;
  ENSP ID: ENSP00000446835

SEQ ID NO: 3540 - protein, 128 aa, Homo sapiens; identical to SEQ ID NO: 3532
  Payload ID: 779;
  Gene Symbol: AGER;
  Gene Name: advanced glycosylation end product-specific receptor;
  ENSP ID: ENSP00000447095

SEQ ID NO: 3541 - protein, 420 aa, Homo sapiens; identical to SEQ ID NO: 3497
  Payload ID: 779;
  Gene Symbol: AGER;
  Gene Name: advanced glycosylation end product-specific receptor;
  Uniprot ID:  Q15109;
  ENSP ID: ENSP00000447301

SEQ ID NO: 3542 - protein, 294 aa, Homo sapiens; identical to SEQ ID NO: 3498
  Payload ID: 779;
  Gene Symbol: AGER;
  Gene Name: advanced glycosylation end product-specific receptor;
  ENSP ID: ENSP00000447531

SEQ ID NO: 3543 - protein, 128 aa, Homo sapiens; identical to SEQ ID NO: 3532
  Payload ID: 779;
  Gene Symbol: AGER;
  Gene Name: advanced glycosylation end product-specific receptor;
  ENSP ID: ENSP00000448028

SEQ ID NO: 3544 - protein, 153 aa, Homo sapiens
  Payload ID: 779;
  Gene Symbol: AGER;
  Gene Name: advanced glycosylation end product-specific receptor;
  ENSP ID: ENSP00000448142
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGILGGLGTAALLIGVILWQRRQRRGEERKAPENQEEEEERAELNQSEEPEAGESSTGGP

SEQ ID NO: 3545 - protein, 133 aa, Homo sapiens; identical to SEQ ID NO: 3495
  Payload ID: 779;
  Gene Symbol: AGER;
  Gene Name: advanced glycosylation end product-specific receptor;
  ENSP ID: ENSP00000448234

SEQ ID NO: 3546 - protein, 294 aa, Homo sapiens; identical to SEQ ID NO: 3498
  Payload ID: 779;
  Gene Symbol: AGER;
  Gene Name: advanced glycosylation end product-specific receptor;
  ENSP ID: ENSP00000448287

SEQ ID NO: 3547 - protein, 153 aa, Homo sapiens; identical to SEQ ID NO: 3544
  Payload ID: 779;
  Gene Symbol: AGER;
  Gene Name: advanced glycosylation end product-specific receptor;
  ENSP ID: ENSP00000448486

SEQ ID NO: 3548 - protein, 128 aa, Homo sapiens
  Payload ID: 779;
  Gene Symbol: AGER;
  Gene Name: advanced glycosylation end product-specific receptor;
  ENSP ID: ENSP00000448525
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQFENLHNYSL

SEQ ID NO: 3549 - protein, 420 aa, Homo sapiens; identical to SEQ ID NO: 3497
  Payload ID: 779;
  Gene Symbol: AGER;
  Gene Name: advanced glycosylation end product-specific receptor;
  Uniprot ID:  Q15109;
  ENSP ID: ENSP00000448579

SEQ ID NO: 3550 - protein, 420 aa, Homo sapiens; identical to SEQ ID NO: 3497
  Payload ID: 779;
  Gene Symbol: AGER;
  Gene Name: advanced glycosylation end product-specific receptor;
  Uniprot ID:  Q15109;
  ENSP ID: ENSP00000448979

SEQ ID NO: 3551 - protein, 153 aa, Homo sapiens
  Payload ID: 779;
  Gene Symbol: AGER;
  Gene Name: advanced glycosylation end product-specific receptor;
  ENSP ID: ENSP00000449037
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGILGGLGTAALLIGVILWQRRQRRGEERKAPENQEEEEERAELNQSEEPEAGESSTGGP

SEQ ID NO: 3552 - protein, 363 aa, Homo sapiens; identical to SEQ ID NO: 3536
  Payload ID: 779;
  Gene Symbol: AGER;
  Gene Name: advanced glycosylation end product-specific receptor;
  ENSP ID: ENSP00000449040

SEQ ID NO: 3553 - protein, 363 aa, Homo sapiens; identical to SEQ ID NO: 3503
  Payload ID: 779;
  Gene Symbol: AGER;
  Gene Name: advanced glycosylation end product-specific receptor;
  Uniprot ID:  Q15109;
  ENSP ID: ENSP00000449042

SEQ ID NO: 3554 - protein, 294 aa, Homo sapiens; identical to SEQ ID NO: 3498
  Payload ID: 779;
  Gene Symbol: AGER;
  Gene Name: advanced glycosylation end product-specific receptor;
  ENSP ID: ENSP00000449091

SEQ ID NO: 3555 - protein, 294 aa, Homo sapiens; identical to SEQ ID NO: 3498
  Payload ID: 779;
  Gene Symbol: AGER;
  Gene Name: advanced glycosylation end product-specific receptor;
  ENSP ID: ENSP00000449100

SEQ ID NO: 3556 - protein, 153 aa, Homo sapiens; identical to SEQ ID NO: 3551
  Payload ID: 779;
  Gene Symbol: AGER;
  Gene Name: advanced glycosylation end product-specific receptor;
  ENSP ID: ENSP00000449143

SEQ ID NO: 3557 - protein, 363 aa, Homo sapiens; identical to SEQ ID NO: 3503
  Payload ID: 779;
  Gene Symbol: AGER;
  Gene Name: advanced glycosylation end product-specific receptor;
  Uniprot ID:  Q15109;
  ENSP ID: ENSP00000449226

SEQ ID NO: 3558 - protein, 294 aa, Homo sapiens; identical to SEQ ID NO: 3498
  Payload ID: 779;
  Gene Symbol: AGER;
  Gene Name: advanced glycosylation end product-specific receptor;
  ENSP ID: ENSP00000449368

SEQ ID NO: 3559 - protein, 133 aa, Homo sapiens; identical to SEQ ID NO: 3495
  Payload ID: 779;
  Gene Symbol: AGER;
  Gene Name: advanced glycosylation end product-specific receptor;
  ENSP ID: ENSP00000449506

SEQ ID NO: 3560 - protein, 133 aa, Homo sapiens; identical to SEQ ID NO: 3495
  Payload ID: 779;
  Gene Symbol: AGER;
  Gene Name: advanced glycosylation end product-specific receptor;
  ENSP ID: ENSP00000449676

SEQ ID NO: 3561 - protein, 363 aa, Homo sapiens; identical to SEQ ID NO: 3503
  Payload ID: 779;
  Gene Symbol: AGER;
  Gene Name: advanced glycosylation end product-specific receptor;
  Uniprot ID:  Q15109;
  ENSP ID: ENSP00000449708

SEQ ID NO: 3562 - protein, 420 aa, Homo sapiens; identical to SEQ ID NO: 3537
  Payload ID: 779;
  Gene Symbol: AGER;
  Gene Name: advanced glycosylation end product-specific receptor;
  ENSP ID: ENSP00000449731

SEQ ID NO: 3563 - protein, 294 aa, Homo sapiens; identical to SEQ ID NO: 3498
  Payload ID: 779;
  Gene Symbol: AGER;
  Gene Name: advanced glycosylation end product-specific receptor;
  ENSP ID: ENSP00000449754

SEQ ID NO: 3564 - protein, 153 aa, Homo sapiens; identical to SEQ ID NO: 3551
  Payload ID: 779;
  Gene Symbol: AGER;
  Gene Name: advanced glycosylation end product-specific receptor;
  ENSP ID: ENSP00000449769

SEQ ID NO: 3565 - protein, 153 aa, Homo sapiens; identical to SEQ ID NO: 3551
  Payload ID: 779;
  Gene Symbol: AGER;
  Gene Name: advanced glycosylation end product-specific receptor;
  ENSP ID: ENSP00000449931

SEQ ID NO: 3566 - protein, 128 aa, Homo sapiens; identical to SEQ ID NO: 3548
  Payload ID: 779;
  Gene Symbol: AGER;
  Gene Name: advanced glycosylation end product-specific receptor;
  ENSP ID: ENSP00000449997

SEQ ID NO: 3567 - protein, 420 aa, Homo sapiens; identical to SEQ ID NO: 3497
  Payload ID: 779;
  Gene Symbol: AGER;
  Gene Name: advanced glycosylation end product-specific receptor;
  Uniprot ID:  Q15109;
  ENSP ID: ENSP00000450134

SEQ ID NO: 3568 - protein, 128 aa, Homo sapiens; identical to SEQ ID NO: 3532
  Payload ID: 779;
  Gene Symbol: AGER;
  Gene Name: advanced glycosylation end product-specific receptor;
  ENSP ID: ENSP00000450205

SEQ ID NO: 3569 - protein, 153 aa, Homo sapiens; identical to SEQ ID NO: 3551
  Payload ID: 779;
  Gene Symbol: AGER;
  Gene Name: advanced glycosylation end product-specific receptor;
  ENSP ID: ENSP00000484081

SEQ ID NO: 3570 - protein, 819 aa, Homo sapiens
  Payload ID: 780;
  Gene Symbol: AVIL;
  Gene Name: advillin;
  Uniprot ID:  O75366;
  ENSP ID: ENSP00000257861
MPLTSAFRAVDNDPGIIVWRIEKMELALVPVSAHGNFYEGDCYVILSTRRVASLLSQDIHFWIGKDSSQDEQSCAAIYTTQLDDYLGGSPVQHREVQYHESDTFRGYFKQGIIYKQGGVASGMKHVETNTYDVKRLLHVKGKRNIRATEVEMSWDSFNRGDVFLLDLGKVIIQWNGPESNSGERLKAMLLAKDIRDRERGGRAKIGVIEGDKEAASPELMKVLQDTLGRRSIIKPTVPDEIIDQKQKSTIMLYHISDSAGQLAVTEVATRPLVQDLLNHDDCYILDQSGTKIYVWKGKGATKAEKQAAMSKALGFIKMKSYPSSTNVETVNDGAESAMFKQLFQKWSVKDQTMGLGKTFSIGKIAKVFQDKFDVTLLHTKPEVAAQERMVDDGNGKVEVWRIENLELVPVEYQWYGFFYGGDCYLVLYTYEVNGKPHHILYIWQGRHASQDELAASAYQAVEVDRQFDGAAVQVRVRMGTEPRHFMAIFKGKLVIFEGGTSRKGNAEPDPPVRLFQIHGNDKSNTKAVEVPAFASSLNSNDVFLLRTQAEHYLWYGKGSSGDERAMAKELASLLCDGSENTVAEGQEPAEFWDLLGGKTPYANDKRLQQEILDVQSRLFECSNKTGQFVVTEITDFTQDDLNPTDVMLLDTWDQVFLWIGAEANATEKESALATAQQYLHTHPSGRDPDTPILIIKQGFEPPIFTGWFLAWDPNIWSAGKTYEQLKEELGDAAAIMRITADMKNATLSLNSNDSEPKYYPIAVLLKNQNQELPEDVNPAKKENYLSEQDFVSVFGITRGQFAALPGWKQLQMKKEKGLF

SEQ ID NO: 3571 - protein, 157 aa, Homo sapiens
  Payload ID: 780;
  Gene Symbol: AVIL;
  Gene Name: advillin;
  ENSP ID: ENSP00000449239
MPLTSAFRAVDNDPGIIVWRIEKMELALVPVSAHGNFYEGDCYVILSTRRVASLLSQDIHFWIGKDSSQDEQSCAAIYTTQLDDYLGGSPVQHREVQYHESDTFRGYFKQGIIYKQGGVASGMKHVETNTYDVKRLLHVKGKRNIRATEVEMSWDSF

SEQ ID NO: 3572 - protein, 76 aa, Homo sapiens
  Payload ID: 780;
  Gene Symbol: AVIL;
  Gene Name: advillin;
  ENSP ID: ENSP00000450188
MPLTSAFRAVDNDPGIIVWRIEETPWKDRWDLLSRLLAASIREMEHVFHGAPWLLQNMGRENGAGAGACERPRQLL

SEQ ID NO: 3573 - protein, 1158 aa, Homo sapiens
  Payload ID: 781;
  Gene Symbol: AEBP1;
  Gene Name: AE binding prt 1;
  Uniprot ID:  Q8IUX7;
  ENSP ID: ENSP00000223357
MAAVRGAPLLSCLLALLALCPGGRPQTVLTDDEIEEFLEGFLSELEPEPREDDVEAPPPPEPTPRVRKAQAGGKPGKRPGTAAEVPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPEEETEQPTLDYNDQIEREDYEDFEYIRRQKQPRPPPSRRRRPERVWPEPPEEKAPAPAPEERIEPPVKPLLPPLPPDYGDGYVIPNYDDMDYYFGPPPPQKPDAERQTDEEKEELKKPKKEDSSPKEETDKWAVEKGKDHKEPRKGEELEEEWTPTEKVKCPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 3574 - protein, 104 aa, Homo sapiens
  Payload ID: 781;
  Gene Symbol: AEBP1;
  Gene Name: AE binding prt 1;
  ENSP ID: ENSP00000397241
RTQWIEVDTRRTTRFTGVITQGRDSSIHDDFVTTFFVGFSNDSQTWVMYTNGYEEMVGTMPRLLALLPLSGRGVGSQRGWQYCSEACLSPDLSWERGQGHTRAE

SEQ ID NO: 3575 - protein, 733 aa, Homo sapiens
  Payload ID: 781;
  Gene Symbol: AEBP1;
  Gene Name: AE binding prt 1;
  Uniprot ID:  Q8IUX7;
  ENSP ID: ENSP00000398878
MRKWWAPCPGSWLCSHCLGEGWALRGAGSTALRPASPQTFHGNVDKDTPVLSELPEPVVARFIRIYPLTWNGSLCMRLEVLGCSVARECGGLAGALSGGGVLGWASRHPAKDNPASLAAVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 3576 - protein, 69 aa, Homo sapiens
  Payload ID: 781;
  Gene Symbol: AEBP1;
  Gene Name: AE binding prt 1;
  ENSP ID: ENSP00000400660
KPDAERQTDEEKEELKKPKKEDSSPKEETDKWAVEKGKDHKEPRKGEELEEEWTPTEKVRPLCRRSPSG

SEQ ID NO: 3577 - protein, 162 aa, Homo sapiens
  Payload ID: 781;
  Gene Symbol: AEBP1;
  Gene Name: AE binding prt 1;
  ENSP ID: ENSP00000401758
MPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPEEETEQPTLDYNDQIEREDYED

SEQ ID NO: 3578 - protein, 66 aa, Homo sapiens
  Payload ID: 781;
  Gene Symbol: AEBP1;
  Gene Name: AE binding prt 1;
  ENSP ID: ENSP00000410349
  MOD_RES (1)..(1): Any amino acid
XFRHHSYKDMRQLMKVVNEECPTITRTYSLGKSSRGLKIYAMEISDNPGEHELGEGLWGPAAGLCC

SEQ ID NO: 3579 - protein, 251 aa, Homo sapiens
  Payload ID: 781;
  Gene Symbol: AEBP1;
  Gene Name: AE binding prt 1;
  ENSP ID: ENSP00000411277
  MOD_RES (1)..(1): Any amino acid
XELEPEPREDDVEAPPPPEPTPRVRKAQAGGKPGKRPGTAAEVPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPPVKPLLPPLPPDYGDGYVIPNYDDMDYYFGPPPPQKPDAERQTDEEKEELKKPKKEDSSPKEETDKWAV

SEQ ID NO: 3580 - protein, 54 aa, Homo sapiens
  Payload ID: 781;
  Gene Symbol: AEBP1;
  Gene Name: AE binding prt 1;
  ENSP ID: ENSP00000416568
LMKVVNEECPTITRTYSLGKSSRGLKIYAMEISDNPGEHELGEGLWGPAAGLCC

SEQ ID NO: 3581 - protein, 503 aa, Homo sapiens
  Payload ID: 782;
  Gene Symbol: AEBP2;
  Gene Name: AE binding prt 2;
  Uniprot ID:  Q6ZN18;
  ENSP ID: ENSP00000266508
MAAAITDMADLEELSRLSPLPPGSPGSAARGRAEPPEEEEEEEEEEEEAEAEAVAALLLNGGSGGGGGGGGGGVGGGEAETMSEPSPESASQAGEDEDEEEDDEEEEDESSSSGGGEEESSAESLVGSSGGSSSDETRSLSPGAASSSSGDGDGKEGLEEPKGPRGSQGGGGGGSSSSSVVSSGGDEGYGTGGGGSSATSGGRRGSLEMSSDGEPLSRMDSEDSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKR

SEQ ID NO: 3582 - protein, 301 aa, Homo sapiens
  Payload ID: 782;
  Gene Symbol: AEBP2;
  Gene Name: AE binding prt 2;
  Uniprot ID:  Q6ZN18;
  ENSP ID: ENSP00000354267
MYTRRYSSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKRTLIRKVFNLYLSKQ

SEQ ID NO: 3583 - protein, 140 aa, Homo sapiens
  Payload ID: 782;
  Gene Symbol: AEBP2;
  Gene Name: AE binding prt 2;
  ENSP ID: ENSP00000381715
LDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKRWSFTLVAQAGVQWRDLGSPQPPLPGFKRFFCLSFLSSWD

SEQ ID NO: 3584 - protein, 517 aa, Homo sapiens
  Payload ID: 782;
  Gene Symbol: AEBP2;
  Gene Name: AE binding prt 2;
  Uniprot ID:  Q6ZN18;
  ENSP ID: ENSP00000381840
MAAAITDMADLEELSRLSPLPPGSPGSAARGRAEPPEEEEEEEEEEEEAEAEAVAALLLNGGSGGGGGGGGGGVGGGEAETMSEPSPESASQAGEDEDEEEDDEEEEDESSSSGGGEEESSAESLVGSSGGSSSDETRSLSPGAASSSSGDGDGKEGLEEPKGPRGSQGGGGGGSSSSSVVSSGGDEGYGTGGGGSSATSGGRRGSLEMSSDGEPLSRMDSEDSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKRTLIRKVFNLYLSKQ

SEQ ID NO: 3585 - protein, 274 aa, Homo sapiens
  Payload ID: 782;
  Gene Symbol: AEBP2;
  Gene Name: AE binding prt 2;
  ENSP ID: ENSP00000437983
MDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKR

SEQ ID NO: 3586 - protein, 110 aa, Homo sapiens
  Payload ID: 782;
  Gene Symbol: AEBP2;
  Gene Name: AE binding prt 2;
  ENSP ID: ENSP00000444255
MDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASF

SEQ ID NO: 3587 - protein, 130 aa, Homo sapiens
  Payload ID: 782;
  Gene Symbol: AEBP2;
  Gene Name: AE binding prt 2;
  ENSP ID: ENSP00000445587
LARPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKRSDKPFTFCHDCEASSAM

SEQ ID NO: 3588 - protein, 339 aa, Homo sapiens
  Payload ID: 783;
  Gene Symbol:;
  Gene Name: AF011889.5;
  ENSP ID: ENSP00000477056
MKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 3589 - protein, 124 aa, Homo sapiens [sequence omitted]

SEQ ID NO: 3590 - protein, 120 aa, Homo sapiens
  Payload ID: 785;
  Gene Symbol:;
  Gene Name: AF131216.1;
  ENSP ID: ENSP00000485671
MPPETQPDQKMCVPTRKKACLCLHALPLPFLTTYKYSLSEEVREEGGGPCLAFLRLSSIPSRSSSERGAAVNCDNCYALALKTWQVGDGGGDCDLTESSRGQGGTQGHSTGSPRAPRHEV

SEQ ID NO: 3591 - protein, 165 aa, Homo sapiens
  Payload ID: 786;
  Gene Symbol:;
  Gene Name: AF165138.7;
  ENSP ID: ENSP00000383407
MNLFCISLEGSMDSLYEPIPEQQANQENMSSRTDSPIPPFGESEQTPNNLFVGVSNLENAKPKKRKLFRRFMSENKIFEGKTVNDKIWQEHSKHKNDSHIRRPCQLKDLNEDDFLSNNIHTYQGKTLQGTSYQVTSECWSPFHYQRHVETTVDELVRHFFPDVTI

SEQ ID NO: 3592 - protein, 152 aa, Homo sapiens
  Payload ID: 786;
  Gene Symbol:;
  Gene Name: AF165138.7;
  ENSP ID: ENSP00000401381
EGSMDSLYEPIPEQQANQENMSSRTDSPIPPFGESEQTPNNLFVGVSNLENAKPKKRKLFRRFMSENKIFEGKTVNDKIWQEHSKHKNDSHIRRPCQLKDLNEDDFLSNNIHTYQGKTLQGTSYQVTSECWSPFHYQRHVETTVDELAQEFM

SEQ ID NO: 3593 - protein, 1210 aa, Homo sapiens
  Payload ID: 787;
  Gene Symbol: AFF1;
  Gene Name: AF4/FMR2 family, member 1;
  Uniprot ID:  P51825;
  ENSP ID: ENSP00000305689
MAAQSSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAPEPEPPTTNKWQLDNWLTKVSQPAAPPEGPRSTEPPRRHPESKGSSDSATSQEHSESKDPPPKSSSKAPRAPPEAPHPGKRSCQKSPAQQEPPQRQTVGTKQPKKPVKASARAGSRTSLQGEREPGLLPYGSRDQTSKDKPKVKTKGRPRAAASNEPKPAVPPSSEKKKHKSSLPAPSKALSGPEPAKDNVEDRTPEHFALVPLTESQGPPHSGSGSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKSASSTKSNHKDSSIPKQRRVEGKGSRSSSEHKGSSGDTANPFPVPSLPNGNSKPGKPQVKFDKQQADLHMREAKKMKQKAELMTDRVGKAFKYLEAVLSFIECGIATESESQSSKSAYSVYSETVDLIKFIMSLKSFSDATAPTQEKIFAVLCMRCQSILNMAMFRCKKDIAIKYSRTLNKHFESSSKVAQAPSPCIASTGTPSPLSPMPSPASSVGSQSSAGSVGSSGVAATISTPVTIQNMTSSYVTITSHVLTAFDLWEQAEALTRKNKEFFARLSTNVCTLALNSSLVDLVHYTRQGFQQLQELTKTP

SEQ ID NO: 3594 - protein, 1218 aa, Homo sapiens
  Payload ID: 787;
  Gene Symbol: AFF1;
  Gene Name: AF4/FMR2 family, member 1;
  Uniprot ID:  P51825;
  ENSP ID: ENSP00000378578
MAFTERVNSSGNSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAPEPEPPTTNKWQLDNWLTKVSQPAAPPEGPRSTEPPRRHPESKGSSDSATSQEHSESKDPPPKSSSKAPRAPPEAPHPGKRSCQKSPAQQEPPQRQTVGTKQPKKPVKASARAGSRTSLQGEREPGLLPYGSRDQTSKDKPKVKTKGRPRAAASNEPKPAVPPSSEKKKHKSSLPAPSKALSGPEPAKDNVEDRTPEHFALVPLTESQGPPHSGSGSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKSASSTKSNHKDSSIPKQRRVEGKGSRSSSEHKGSSGDTANPFPVPSLPNGNSKPGKPQVKFDKQQADLHMREAKKMKQKAELMTDRVGKAFKYLEAVLSFIECGIATESESQSSKSAYSVYSETVDLIKFIMSLKSFSDATAPTQEKIFAVLCMRCQSILNMAMFRCKKDIAIKYSRTLNKHFESSSKVAQAPSPCIARSTGTPSPLSPMPSPASSVGSQSSAGSVGSSGVAATISTPVTIQNMTSSYVTITSHVLTAFDLWEQAEALTRKNKEFFARLSTNVCTLALNSSLVDLVHYTRQGFQQLQELTKTP

SEQ ID NO: 3595 - protein, 417 aa, Homo sapiens
  Payload ID: 787;
  Gene Symbol: AFF1;
  Gene Name: AF4/FMR2 family, member 1;
  ENSP ID: ENSP00000424483
MAFTERVNSSGNSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKDSQHVSSVTQNQKQYDTSSKTHSNSQQGTSSMLEDDLQLSDSEDSDSEQ

SEQ ID NO: 3596 - protein, 137 aa, Homo sapiens
  Payload ID: 787;
  Gene Symbol: AFF1;
  Gene Name: AF4/FMR2 family, member 1;
  ENSP ID: ENSP00000424766
MTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLE

SEQ ID NO: 3597 - protein, 194 aa, Homo sapiens
  Payload ID: 787;
  Gene Symbol: AFF1;
  Gene Name: AF4/FMR2 family, member 1;
  ENSP ID: ENSP00000424881
TVSISFNAVVPSGLGPSSHARQRQLWYQLPGSPVALLQTYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAP

SEQ ID NO: 3598 - protein, 52 aa, Homo sapiens
  Payload ID: 787;
  Gene Symbol: AFF1;
  Gene Name: AF4/FMR2 family, member 1;
  ENSP ID: ENSP00000425755
MLGNYEEVKEFLSTKSHTHRLDASENRLGKPKYPLIPDKGSSIPSSSFHTSV

SEQ ID NO: 3599 - protein, 406 aa, Homo sapiens
  Payload ID: 787;
  Gene Symbol: AFF1;
  Gene Name: AF4/FMR2 family, member 1;
  ENSP ID: ENSP00000427593
MAFTERVNSSGNSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVETYSNEVHCVEEILKEMTHSWPPPLTAIHTPSTAEPSKFPFPTKDSQHVSSVTQ

SEQ ID NO: 3600 - protein, 1205 aa, Homo sapiens
  Payload ID: 787;
  Gene Symbol: AFF1;
  Gene Name: AF4/FMR2 family, member 1;
  ENSP ID: ENSP00000440843
MAAQSSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAPEPEPPTTNKWQLDNWLTKVSQPAAPPEGPRSTEPPRRHPESKGSSDSATSQEHSESKDPPPKSSSKAPRAPPEAPHPGKRSCQKSPAQQEPPQRQTVGTKQPKKPVKASARAGSRTSLQGEREPGLLPYGSRDQTSKDKPKVKTKGRPRAAASNEPKPAVPPSSEKKKHKSSLPAPSKALSGPEPAKDNVEDRTPEHFALVPLTESQGPPHSGSGSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKVPAVPRATTDSSIPKQRRVEGKGSRSSSEHKGSSGDTANPFPVPSLPNGNSKPGKPQVKFDKQQADLHMREAKKMKQKAELMTDRVGKAFKYLEAVLSFIECGIATESESQSSKSAYSVYSETVDLIKFIMSLKSFSDATAPTQEKIFAVLCMRCQSILNMAMFRCKKDIAIKYSRTLNKHFESSSKVAQAPSPCIARSTGTPSPLSPMPSPASSVGSQSSAGSVGSSGVAATISTPVTIQNMTSSYVTITSHVLTAFDLWEQAEALTRKNKEFFARLSQMCAPWPSTAVWWTWCTIHDRVFSSYKN

SEQ ID NO: 3601 - protein, 952 aa, Homo sapiens
  Payload ID: 788;
  Gene Symbol: AFF2;
  Gene Name: AF4/FMR2 family, member 2;
  Uniprot ID:  P51816;
  ENSP ID: ENSP00000286437
MKFKRRHQAFPSFFKMKVSLPSDPSCVEEILRESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 3602 - protein, 1276 aa, Homo sapiens
  Payload ID: 788;
  Gene Symbol: AFF2;
  Gene Name: AF4/FMR2 family, member 2;
  Uniprot ID:  P51816;
  ENSP ID: ENSP00000345459
MDLFDFFRDWDLEQQCHYEQDRSALKKREWERRNQEVQQEDDLFSSGFDLFGEPYKTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 3603 - protein, 1276 aa, Homo sapiens
  Payload ID: 788;
  Gene Symbol: AFF2;
  Gene Name: AF4/FMR2 family, member 2;
  Uniprot ID:  P51816;
  ENSP ID: ENSP00000359486
MDLFDFFRDWDLEQQCHYEQDRSALKKREWERRNQEVQQEDDLFSSGFDLFGEPYKVAEYTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 3604 - protein, 427 aa, Homo sapiens
  Payload ID: 788;
  Gene Symbol: AFF2;
  Gene Name: AF4/FMR2 family, member 2;
  Uniprot ID:  P51816;
  ENSP ID: ENSP00000359487
MDLFDFFRDWDLEQQCHYEQDRSALKKREWERRNQEVQQEDDLFSSGFDLFGEPYKTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKMLEDDLKLSSDEDDLEPVKTLTTQCTATELYQAVEKAKPRNNPVK

SEQ ID NO: 3605 - protein, 1311 aa, Homo sapiens
  Payload ID: 788;
  Gene Symbol: AFF2;
  Gene Name: AF4/FMR2 family, member 2;
  Uniprot ID:  P51816;
  ENSP ID: ENSP00000359489
MDLFDFFRDWDLEQQCHYEQDRSALKKREWERRNQEVQQEDDLFSSGFDLFGEPYKVAEYTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILREMTHSWPTPLTSMHTAGHSEQSTFSIPGQESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 3606 - protein, 1226 aa, Homo sapiens
  Payload ID: 789;
  Gene Symbol: AFF3;
  Gene Name: AF4/FMR2 family, member 3;
  Uniprot ID:  P51826;
  ENSP ID: ENSP00000317421
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDNGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSVAIPINKNEKMLRSPISPLSDASKHKYTSEDLTSSSRPNGNSLFTSASSSKKPKADSQLQPHGGDLTKAAHNNSENIPLHKSRPQTKPWSPGSNGHRDCKRQKLVFDDMPRSADYFMQEAKRMKHKADAMVEKFGKALNYAEAALSFIECGNAMEQGPMESKSPYTMYSETVELIRYAMRLKTHSGPNATPEDKQLAALCYRCLALLYWRMFRLKRDHAVKYSKALIDYFKNSSKAAQAPSPWGASGKSTGTPSPMSPNPSPASSVGSQGSLSNASALSPSTIVSIPQRIHQMAANHVSITNSILHSYDYWEMADNLAKENREFFNDLDLLMGPVTLHSSMEHLVQYSQQGLHWLRNSAHLS

SEQ ID NO: 3607 - protein, 1251 aa, Homo sapiens
  Payload ID: 789;
  Gene Symbol: AFF3;
  Gene Name: AF4/FMR2 family, member 3;
  Uniprot ID:  P51826;
  ENSP ID: ENSP00000386834
MDSFDLALLQEWDLESLWGEDILNQRNDSLVVEFQSSASRCRSVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDNGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSVAIPINKNEKMLRSPISPLSDASKHKYTSEDLTSSSRPNGNSLFTSASSSKKPKADSQLQPHGGDLTKAAHNNSENIPLHKSRPQTKPWSPGSNGHRDCKRQKLVFDDMPRSADYFMQEAKRMKHKADAMVEKFGKALNYAEAALSFIECGNAMEQGPMESKSPYTMYSETVELIRYAMRLKTHSGPNATPEDKQLAALCYRCLALLYWRMFRLKRDHAVKYSKALIDYFKNSSKAAQAPSPWGASGKSTGTPSPMSPNPSPASSVGSQGSLSNASALSPSTIVSIPQRIHQMAANHVSITNSILHSYDYWEMADNLAKENREFFNDLDLLMGPVTLHSSMEHLVQYSQQGLHWLRNSAHLS

SEQ ID NO: 3608 - protein, 1226 aa, Homo sapiens; identical to SEQ ID NO: 3606
  Payload ID: 789;
  Gene Symbol: AFF3;
  Gene Name: AF4/FMR2 family, member 3;
  Uniprot ID:  P51826;
  ENSP ID: ENSP00000387207

SEQ ID NO: 3609 - protein, 155 aa, Homo sapiens
  Payload ID: 789;
  Gene Symbol: AFF3;
  Gene Name: AF4/FMR2 family, member 3;
  ENSP ID: ENSP00000393732
MSKKLITCLSRPETGGKFEVDTQRPVCPPSRARAARASAAAVAAAATLTPPTMDSFDLALLQEWDLESLWGEDILNQRNDSLVVEFQSSASRCRSVYEPDRNALRRKERERRNQETQQDDGTFNSSYSLFSEPYKTNKGDELSNRIQNTLGNYDE

SEQ ID NO: 3610 - protein, 99 aa, Homo sapiens
  Payload ID: 789;
  Gene Symbol: AFF3;
  Gene Name: AF4/FMR2 family, member 3;
  ENSP ID: ENSP00000395068
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPG

SEQ ID NO: 3611 - protein, 155 aa, Homo sapiens
  Payload ID: 789;
  Gene Symbol: AFF3;
  Gene Name: AF4/FMR2 family, member 3;
  ENSP ID: ENSP00000396582
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPP

SEQ ID NO: 3612 - protein, 128 aa, Homo sapiens
  Payload ID: 789;
  Gene Symbol: AFF3;
  Gene Name: AF4/FMR2 family, member 3;
  ENSP ID: ENSP00000399795
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICST

SEQ ID NO: 3613 - protein, 161 aa, Homo sapiens
  Payload ID: 789;
  Gene Symbol: AFF3;
  Gene Name: AF4/FMR2 family, member 3;
  ENSP ID: ENSP00000406484
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQR

SEQ ID NO: 3614 - protein, 183 aa, Homo sapiens
  Payload ID: 789;
  Gene Symbol: AFF3;
  Gene Name: AF4/FMR2 family, member 3;
  ENSP ID: ENSP00000407448
MTLRLDAGGIPSLAPRVYISGSPSQRFLPRKRNKGESAGRDSLLAGSARFGSRGEAQLQGSELLSRNSGESLVRIRSCGQELITCLSRPETGGKFEVDTQRPVCPPSRARAARASAAAVAAAATLTPPTMDSFDLALLQEWDLESLWGEDILNQRNDSLVVEFQSSASRCRSVYEPDRNALRR

SEQ ID NO: 3615 - protein, 114 aa, Homo sapiens
  Payload ID: 789;
  Gene Symbol: AFF3;
  Gene Name: AF4/FMR2 family, member 3;
  ENSP ID: ENSP00000411383
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVA

SEQ ID NO: 3616 - protein, 179 aa, Homo sapiens
  Payload ID: 789;
  Gene Symbol: AFF3;
  Gene Name: AF4/FMR2 family, member 3;
  ENSP ID: ENSP00000414099
  MOD_RES (1)..(1): Any amino acid
XASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDNGTSNTSMLEDDLKLSSDEEENEQQAAQRTALRALSDSLSW

SEQ ID NO: 3617 - protein, 17 aa, Homo sapiens
  Payload ID: 789;
  Gene Symbol: AFF3;
  Gene Name: AF4/FMR2 family, member 3;
  ENSP ID: ENSP00000416131
MDSFDLALLQEWDLESL

SEQ ID NO: 3618 - protein, 185 aa, Homo sapiens
  Payload ID: 789;
  Gene Symbol: AFF3;
  Gene Name: AF4/FMR2 family, member 3;
  ENSP ID: ENSP00000416685
GHRDCKRQKLVFDDMPRSADYFMQEAKRMKHKADAMVEKFGKALNYAEAALSFIECGNAMEQGPMESKSPYTMYSETVELIRYAMRLKTHSGPNATPEDKQLAALCYRCLALLYWRMFRLKRDHAVKYSKALIDYFKNSSKAAQAPSPWGASGNSVGSQGSLSNASALSPSTIVSIPQRIHQMAA

SEQ ID NO: 3619 - protein, 1163 aa, Homo sapiens
  Payload ID: 790;
  Gene Symbol: AFF4;
  Gene Name: AF4/FMR2 family, member 4;
  Uniprot ID:  Q9UHB7;
  ENSP ID: ENSP00000265343
MNREDRNVLRMKERERRNQEIQQGEDAFPPSSPLFAEPYKVTSKEDKLSSRIQSMLGNYDEMKDFIGDRSIPKLVAIPKPTVPPSADEKSNPNFFEQRHGGSHQSSKWTPVGPAPSTSQSQKRSSGLQSGHSSQRTSAGSSSGTNSSGQRHDRESYNNSGSSSRKKGQHGSEHSKSRSSSPGKPQAVSSLNSSHSRSHGNDHHSKEHQRSKSPRDPDANWDSPSRVPFSSGQHSTQSFPPSLMSKSNSMLQKPTAYVRPMDGQESMEPKLSSEHYSSQSHGNSMTELKPSSKAHLTKLKIPSQPLDASASGDVSCVDEILKEMTHSWPPPLTAIHTPCKTEPSKFPFPTKESQQSNFGTGEQKRYNPSKTSNGHQSKSMLKDDLKLSSSEDSDGEQDCDKTMPRSTPGSNSEPSHHNSEGADNSRDDSSSHSGSESSSGSDSESESSSSDSEANEPSQSASPEPEPPPTNKWQLDNWLNKVNPHKVSPASSVDSNIPSSQGYKKEGREQGTGNSYTDTSGPKETSSATPGRDSKTIQKGSESGRGRQKSPAQSDSTTQRRTVGKKQPKKAEKAAAEEPRGGLKIESETPVDLASSMPSSRHKAATKGSRKPNIKKESKSSPRPTAEKKKYKSTSKSSQKSREIIETDTSSSDSDESESLPPSSQTPKYPESNRTPVKPSSVEEEDSFFRQRMFSPMEEKELLSPLSEPDDRYPLIVKIDLNLLTRIPGKPYKETEPPKGEKKNVPEKHTREAQKQASEKVSNKGKRKHKNEDDNRASESKKPKTEDKNSAGHKPSSNRESSKQSAAKEKDLLPSPAGPVPSKDPKTEHGSRKRTISQSSSLKSSSNSNKETSGSSKNSSSTSKQKKTEGKTSSSSKEVKEKAPSSSSNCPPSAPTLDSSKPRRTKLVFDDRNYSADHYLQEAKKLKHNADALSDRFEKAVYYLDAVVSFIECGNALEKNAQESKSPFPMYSETVDLIKYTMKLKNYLAPDATAADKRLTVLCLRCESLLYLRLFKLKKENALKYSKTLTEHLKNSYNNSQAPSPGLGSKAVGMPSPVSPKLSPGNSGNYSSGASSASASGSSVTIPQKIHQMAASYVQVTSNFLYATEIWDQAEQLSKEQKEFFAELDKVMGPLIFNASIMTDLVRYTRQGLHWLRQDAKLIS

SEQ ID NO: 3620 - protein, 900 aa, Homo sapiens
  Payload ID: 790;
  Gene Symbol: AFF4;
  Gene Name: AF4/FMR2 family, member 4;
  Uniprot ID:  Q9UHB7;
  ENSP ID: ENSP00000367858
MNREDRNVLRMKERERRNQEIQQGEDAFPPSSPLFAEPYKVTSKEDKLSSRIQSMLGNYDEMKDFIGDRSIPKLVAIPKPTVPPSADEKSNPNFFEQRHGGSHQSSKWTPVGPAPSTSQSQKRSSGLQSGHSSQRTSAGSSSGTNSSGQRHDRESYNNSGSSSRKKGQHGSEHSKSRSSSPGKPQAVSSLNSSHSRSHGNDHHSKEHQRSKSPRDPDANWDSPSRVPFSSGQHSTQSFPPSLMSKSNSMLQKPTAYVRPMDGQESMEPKLSSEHYSSQSHGNSMTELKPSSKAHLTKLKIPSQPLDASASGDVSCVDEILKEMTHSWPPPLTAIHTPCKTEPSKFPFPTKESQQSNFGTGEQKRYNPSKTSNGHQSKSMLKDDLKLSSSEDSDGEQDCDKTMPRSTPGSNSEPSHHNSEGADNSRDDSSSHSGSESSSGSDSESESSSSDSEANEPSQSASPEPEPPPTNKWQLDNWLNKVNPHKVSPASSVDSNIPSSQGYKKEGREQGTGNSYTDTSGPKETSSATPGRDSKTIQKGSESGRGRQKSPAQSDSTTQRRTVGKKQPKKAEKAAAEEPRGGLKIESETPVDLASSMPSSRHKAATKGSRKPNIKKESKSSPRPTAEKKKYKSTSKSSQKSREIIETDTSSSDSDESESLPPSSQTPKYPESNRTPVKPSSVEEEDSFFRQRMFSPMEEKELLSPLSEPDDRYPLIVKIDLNLLTRIPGKPYKETEPPKGEKKNVPEKHTREAQKQASEKVSNKGKRKHKNEDDNRASESKKPKTEDKNSAGHKPSSNRESSKQSAAKEKDLLPSPAGPVPSKDPKTEHGSRKRTISQSSSLKSSSNSNKETSGSSKNSSSTSKQKKTEGKTSSSSKEVKVKCWGPGAFENHSTCHVTFPG

SEQ ID NO: 3621 - protein, 148 aa, Homo sapiens
  Payload ID: 790;
  Gene Symbol: AFF4;
  Gene Name: AF4/FMR2 family, member 4;
  ENSP ID: ENSP00000395268
MNREDRNVLRMKERERRNQEIQQGEDAFPPSSPLFAEPYKVTSKEDKLSSRIQSMLGNYDEMKDFIGDRSIPKLVAIPKPTVPPSADEKSNPNFFEQRHGGSHQSSKWTPVGPAPSTSQSQKRSSGLQSGHSSQRTSAGSSSGTNSSG

SEQ ID NO: 3622 - protein, 171 aa, Homo sapiens
  Payload ID: 790;
  Gene Symbol: AFF4;
  Gene Name: AF4/FMR2 family, member 4;
  ENSP ID: ENSP00000409069
  MOD_RES (1)..(1): Any amino acid
XSQSHGNSMTELKPSSKAHLTKLKIPSQPLDASASGDVSCVDEILKESQQSNFGTGEQKRYNPSKTSNGHQSKSMLKDDLKLSSSEDSDGEQDCDKTMPRSTPGSNSEPSHHNSEGADNSRDDSSSHSGSESSSGSDSESESSSSDSEANEPSQSASPEPEPPPTNKWQLD

SEQ ID NO: 3623 - protein, 599 aa, Homo sapiens
  Payload ID: 791;
  Gene Symbol: AFM;
  Gene Name: afamin;
  Uniprot ID:  P43652;
  ENSP ID: ENSP00000226355
MKLLKLTGFIFFLFFLTESLTLPTQPRDIENFNSTQKFIEDNIEYITIIAFAQYVQEATFEEMEKLVKDMVEYKDRCMADKTLPECSKLPNNVLQEKICAMEGLPQKHNFSHCCSKVDAQRRLCFFYNKKSDVGFLPPFPTLDPEEKCQAYESNRESLLNHFLYEVARRNPFVFAPTLLTVAVHFEEVAKSCCEEQNKVNCLQTRAIPVTQYLKAFSSYQKHVCGALLKFGTKVVHFIYIAILSQKFPKIEFKELISLVEDVSSNYDGCCEGDVVQCIRDTSKVMNHICSKQDSISSKIKECCEKKIPERGQCIINSNKDDRPKDLSLREGKFTDSENVCQERDADPDTFFAKFTFEYSRRHPDLSIPELLRIVQIYKDLLRNCCNTENPPGCYRYAEDKFNETTEKSLKMVQQECKHFQNLGKDGLKYHYLIRLTKIAPQLSTEELVSLGEKMVTAFTTCCTLSEEFACVDNLADLVFGELCGVNENRTINPAVDHCCKTNFAFRRPCFESLKADKTYVPPPFSQDLFTFHADMCQSQNEELQRKTDRFLVNLVKLKHELTDEELQSLFTNFANVVDKCCKAESPEVCFNEESPKIGN

SEQ ID NO: 3624 - protein, 797 aa, Homo sapiens
  Payload ID: 792;
  Gene Symbol: AFG3L2;
  Gene Name: AFG3-like AAA ATPase 2;
  Uniprot ID:  Q9Y4W6;
  ENSP ID: ENSP00000269143
MAHRCLRLWGRGGCWPRGLQQLLVPGGVGPGEQPCLRTLYRFVTTQARASRNSLLTDIIAAYQRFCSRPPKGFEKYFPNGKNGKKASEPKEVMGEKKESKPAATTRSSGGGGGGGGKRGGKKDDSHWWSRFQKGDIPWDDKDFRMFFLWTALFWGGVMFYLLLKRSGREITWKDFVNNYLSKGVVDRLEVVNKRFVRVTFTPGKTPVDGQYVWFNIGSVDTFERNLETLQQELGIEGENRVPVVYIAESDGSFLLSMLPTVLIIAFLLYTIRRGPAGIGRTGRGMGGLFSVGETTAKVLKDEIDVKFKDVAGCEEAKLEIMEFVNFLKNPKQYQDLGAKIPKGAILTGPPGTGKTLLAKATAGEANVPFITVSGSEFLEMFVGVGPARVRDLFALARKNAPCILFIDEIDAVGRKRGRGNFGGQSEQENTLNQLLVEMDGFNTTTNVVILAGTNRPDILDPALLRPGRFDRQIFIGPPDIKGRASIFKVHLRPLKLDSTLEKDKLARKLASLTPGFSGADVANVCNEAALIAARHLSDSINQKHFEQAIERVIGGLEKKTQVLQPEEKKTVAYHEAGHAVAGWYLEHADPLLKVSIIPRGKGLGYAQYLPKEQYLYTKEQLLDRMCMTLGGRVSEEIFFGRITTGAQDDLRKVTQSAYAQIVQFGMNEKVGQISFDLPRQGDMVLEKPYSEATARLIDDEVRILINDAYKRTVALLTEKKADVEKVALLLLEKEVLDKNDMVELLGPRPFAEKSTYEEFVEGTGSLDEDTSLPEGLKDWNKEREKEKEEPPGEKVAN

SEQ ID NO: 3625 - protein, 209 aa, Homo sapiens
  Payload ID: 792;
  Gene Symbol: AFG3L2;
  Gene Name: AFG3-like AAA ATPase 2;
  ENSP ID: ENSP00000467236
  MOD_RES (1)..(1): Any amino acid
XVGPGEQPCLRTGDIPWDDKDFRMFFLWTALFWGGVMFYLLLKRSGREITWKDFVNNYLSKGVVDRLEVVNKRFVRVTFTPGKTPVDGQYVWFNIGSVDTFERNLETLQQELGIEGENRVPVVYIAESDGSFLLSMLPTVLIIAFLLYTIRRGPAGIGRTGRGMGGLFSVGETTAKVLKDEIDVKFKDVAGCEEAKLEIMEFVNFLKNP

SEQ ID NO: 3626 - protein, 936 aa, Homo sapiens
  Payload ID: 793;
  Gene Symbol: AFTPH;
  Gene Name: aftiphilin;
  Uniprot ID:  Q6ULP2;
  ENSP ID: ENSP00000238855
MEPDIIRMYSSSPPPLDNGAEDDDDDEFGEFGGFSEVSPSGVGFVDFDTPDYTRPKEEFVPSNHFMPIHEFSENVDSLTSFKSIKNGNDKDITAELSAPVKGQSDVLLSTTSKEIISSEMLATSIDGMERPGNLNKVVEQRQNVGTLESFSPGDFRTNMNVVHQNKQLESCNGEKPPCLEILTNGFAVLETVNPQGTDDLDNVADSKGRKPLSTHSTEYNLDSVPSPAEEFADFATFSKKERIQLEEIECAVLNDREALTIRENNKINRVNELNSVKEVALGRSLDNKGDTDGEDQVCVSEISIVTNRGFSVEKQGLPTLQQDEFLQSGVQSKAWSLVDSADNSEAIRREQCKTEEKLDLLTSKCAHLCMDSVKTSDDEVGSPKEESRKFTNFQSPNIDPTEENDLDDSLSVKNGDSSNDFVTCNDINEDDFGDFGDFGSASGSTPPFVTGTQDSMSDATFEESSEHFPHFSEPGDDFGEFGDINAVSCQEETILTKSDLKQTSDNLSEECQLARKSSGTGTEPVAKLKNGQEGEIGHFDSVPNIQDDCNGFQDSDDFADFSSAGPSQVVDWNAFEDEQKDSCSWAAFGDQQATESHHRKEAWQSHRTDENIDTPGTPKTHSVPSATSKGAVASGHLQESATSVQTALLNRLERIFEACFPSILVPDAEEEVTSLKHLLETSTLPIKTREALPESGELLDVWTELQDIHDAHGLRYQWGGSHSNKKLLSSLGIDTRNILFTGNKKQPVIVPMYAAGLGMLEPTKEPLKPLSAAEKIASIGQTATMSPDMNTCTSDQFQESLPPVQFDWSSSGLTNPLDASGGSTLLNLDFFGPVDDSSSSSSTTIPGVDPELYELTTSKLEISTSSLKVTDAFARLMSTVEKTSTSTRKPKREEHLSEEAIKVIAGLPDLTFMHAKVLMFPATLTPSTSSQEKADG

SEQ ID NO: 3627 - protein, 909 aa, Homo sapiens
  Payload ID: 793;
  Gene Symbol: AFTPH;
  Gene Name: aftiphilin;
  Uniprot ID:  Q6ULP2;
  ENSP ID: ENSP00000238856
MEPDIIRMYSSSPPPLDNGAEDDDDDEFGEFGGFSEVSPSGVGFVDFDTPDYTRPKEEFVPSNHFMPIHEFSENVDSLTSFKSIKNGNDKDITAELSAPVKGQSDVLLSTTSKEIISSEMLATSIDGMERPGNLNKVVEQRQNVGTLESFSPGDFRTNMNVVHQNKQLESCNGEKPPCLEILTNGFAVLETVNPQGTDDLDNVADSKGRKPLSTHSTEYNLDSVPSPAEEFADFATFSKKERIQLEEIECAVLNDREALTIRENNKINRVNELNSVKEVALGRSLDNKGDTDGEDQVCVSEISIVTNRGFSVEKQGLPTLQQDEFLQSGVQSKAWSLVDSADNSEAIRREQCKTEEKLDLLTSKCAHLCMDSVKTSDDEVGSPKEESRKFTNFQSPNIDPTEENDLDDSLSVKNGDSSNDFVTCNDINEDDFGDFGDFGSASGSTPPFVTGTQDSMSDATFEESSEHFPHFSEPGDDFGEFGDINAVSCQEETILTKSDLKQTSDNLSEECQLARKSSGTGTEPVAKLKNGQEGEIGHFDSVPNIQDDCNGFQDSDDFADFSSAGPSQVVDWNAFEDEQKDSCSWAAFGDQQATESHHRKEAWQSHRTDENIDTPGTPKTHSVPSATSKGAVASGHLQESATSVQTALLNRLERIFEACFPSILVPDAEEEVTSLKHLLETSTLPIKTREALPESGELLDVWTELQDIHDAHGLRYQWGGSHSNKKLLSSLGIDTRNILFTGNKKQPVIVPMYAAGLGMLEPTKEPLKPLSAAEKIASIGQTATMSPDMNTCTSDQFQESLPPVQFDWSSSGLTNPLDGVDPELYELTTSKLEISTSSLKVTDAFARLMSTVEKTSTSTSRKPKREEHLSEEAIKVIAGLPDLTFMHAKVLMFPATLTPSTSSQEKADG

SEQ ID NO: 3628 - protein, 592 aa, Homo sapiens
  Payload ID: 793;
  Gene Symbol: AFTPH;
  Gene Name: aftiphilin;
  ENSP ID: ENSP00000386913
  MOD_RES (1)..(1): Any amino acid
XIRREQCKTEEKLDLLTSKCAHLCMDSVKTSDDEVGSPKEESRKFTNFQSPNIDPTEENDLDDSLSVKNGDSSNDFVTCNDINEDDFGDFGDFGSASGSTPPFVTGTQDSMSDATFEESSEHFPHFSEPGDDFGEFGDINAVSCQEETILTKSDLKQTSDNLSEECQLARKSSGTGTEPVAKLKNGQEGEIGHFDSVPNIQDDCNGFQDSDDFADFSSAGPSQVVDWNAFEDEQKDSCSWAAFGDQQATESHHRKEAWQSHRTDENIDTPGTPKTHSVPSATSKGAVASGHLQESATSVQTALLNRLERIFEACFPSILVPDAEEEVTSLKHLLETSTLPIKTREALPESGELLDVWTELQDIHDAHGLRYQWGGSHSNKKLLSSLGIDTRNILFTGNKKQPVIVPMYAAGLGMLEPTKEPLKPLSAAEKIASIGQTATMSPDMNTCTSDQFQESLPPVQFDWSSSGLTNPLDASGGSTLLNLDFFGPVDDSSSSSSTTIPGVDPELYELTTSKLEISTSSLKVTDAFARLMSTVEKTSTSTSRKPKREEHLSEEAIKVIAGLPDLTFMHAKVLMFPATLTPSTSSQEKADG

SEQ ID NO: 3629 - protein, 936 aa, Homo sapiens; identical to SEQ ID NO: 3626
  Payload ID: 793;
  Gene Symbol: AFTPH;
  Gene Name: aftiphilin;
  Uniprot ID:  Q6ULP2;
  ENSP ID: ENSP00000387071

SEQ ID NO: 3630 - protein, 138 aa, Homo sapiens
  Payload ID: 793;
  Gene Symbol: AFTPH;
  Gene Name: aftiphilin;
  ENSP ID: ENSP00000397726
MYAAGLGMLEPTKEPLKPLSAAEKIASIGQTATMSPDMNTCTSDQFQESLPPVQFDWSSSGLTNPLDGVDPELYELTTSKLEISTSSLKVTDAFARLMSTVEKTSTSTRKPKREEHLSEEAIKVIAGLPDLTFMHAKV

SEQ ID NO: 3631 - protein, 227 aa, Homo sapiens
  Payload ID: 793;
  Gene Symbol: AFTPH;
  Gene Name: aftiphilin;
  ENSP ID: ENSP00000489378
FPHFSEPGDDFGEFGDINAVSCQEETILTKSDLKQTSDNLSEECQLARKSSGTGTEPVAKLKNGQEGEIGHFDSVPNIQDDCNGFQDSDDFADFSSAGPSQVVDWNAFEDEQKDSCSWAAFGDQQATESHHRKEAWQSHRTDENIDTPGTPKTHSVPSATSKGAVASGHLQESATSVQGMLEPTKEPLKPLSAAEKIASIGQTATMSPDMNTCTSDQFQVWIRSCMS

SEQ ID NO: 3632 - protein, 107 aa, Homo sapiens
  Payload ID: 794;
  Gene Symbol: ARMS2;
  Gene Name: age-related maculopathy susceptibility 2;
  Uniprot ID:  P0C7Q2;
  ENSP ID: ENSP00000436682
MLRLYPGPMVTEAEGKGGPEMASLSSSVVPVSFISTLRESVLDPGVGGEGASDKQRSKLSLSHSMIPAAKIHTELCLPAFFSPAGTQRRFQQPQHHLTLSIIHTAAR

SEQ ID NO: 3633 - protein, 2431 aa, Homo sapiens
  Payload ID: 795;
  Gene Symbol: ACAN;
  Gene Name: aggrecan;
  ENSP ID: ENSP00000341615
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTATTYKRRLQKRSSRHPRRSRPSTAH

SEQ ID NO: 3634 - protein, 2530 aa, Homo sapiens
  Payload ID: 795;
  Gene Symbol: ACAN;
  Gene Name: aggrecan;
  ENSP ID: ENSP00000387356
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAAAPARSCAEEPCGAGTCKETEGHVICLCPPGYTGEHCNIDQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 3635 - protein, 156 aa, Homo sapiens
  Payload ID: 795;
  Gene Symbol: ACAN;
  Gene Name: aggrecan;
  ENSP ID: ENSP00000452682
  MOD_RES (1)..(1): Any amino acid
XWNDVPCNYHLPFTCKKGTVACGEPPVVEHARTFGQKKDRYEINSLVRYQCTEGFVQRHMPTIRCQPSGHWEEPQITCTDREHHPGHLAEHRPPPTNADYRSGAHGTLGGAAPAQPTEKSFQDAPRTLSPGACQADVHPTQTVSSSCRFLSYKESH

SEQ ID NO: 3636 - protein, 721 aa, Homo sapiens
  Payload ID: 795;
  Gene Symbol: ACAN;
  Gene Name: aggrecan;
  ENSP ID: ENSP00000453003
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGMQPHFGSNSPFCLERTPLGSPDPATTQYPIHQSKKMSVPLGQSQL

SEQ ID NO: 3637 - protein, 2530 aa, Homo sapiens; identical to SEQ ID NO: 3634
  Payload ID: 795;
  Gene Symbol: ACAN;
  Gene Name: aggrecan;
  ENSP ID: ENSP00000453342

SEQ ID NO: 3638 - protein, 2492 aa, Homo sapiens
  Payload ID: 795;
  Gene Symbol: ACAN;
  Gene Name: aggrecan;
  ENSP ID: ENSP00000453499
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 3639 - protein, 226 aa, Homo sapiens
  Payload ID: 795;
  Gene Symbol: ACAN;
  Gene Name: aggrecan;
  ENSP ID: ENSP00000453581
  MOD_RES (1)..(1): Any amino acid
XPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAAAPARSCAEEPCGAGTCKETEGHVICLCPPGYTGEHCNIDIDECLSSPCLNGATCVDAIDSFTCLCLPSYEGDLCEIDQEVCEEGWNKYQGHCYRHFPDRETWVDAERRCREQ

SEQ ID NO: 3640 - protein, 2473 aa, Homo sapiens
  Payload ID: 795;
  Gene Symbol: ACAN;
  Gene Name: aggrecan;
  ENSP ID: ENSP00000484456
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 3641 - protein, 352 aa, Homo sapiens
  Payload ID: 796;
  Gene Symbol: AGMAT;
  Gene Name: agmatine ureohydrolase (agmatinase);
  Uniprot ID:  Q9BSE5;
  ENSP ID: ENSP00000364986
MLRLLASGCARGPGPGVGARPAAGLFHPGRRQSRQASDAPRNQPPSPEFVARPVGVCSMMRLPVQTSPEGLDAAFIGVPLDTGTSNRPGARFGPRRIREESVMLGTVNPSTGALPFQSLMVADLGDVNVNLYNLQDSCRRIQEAYEKIVAAGCIPLTLGGDHTITYPILQAMAKKHGPVGLLHVDAHTDTTDKALGEKLYHGAPFRRCVDEGLLDCKRVVQIGIRGSSTTLDPYRYNRSQGFRVVLAEDCWMKSLVPLMGEVRQQMGGKPIYISFDIDALDPAYAPGTGTPEIAGLTPSQALEIIRGCQGLNVMGCDLVEVSPPYDLSGNTALLAANLLFEMLCALPKVTTV

SEQ ID NO: 3642 - protein, 132 aa, Homo sapiens
  Payload ID: 797;
  Gene Symbol: AGRP;
  Gene Name: agouti related neuropeptide;
  Uniprot ID:  O00253;
  ENSP ID: ENSP00000290953
MLTAAVLSCALLLALPATRGAQMGLAPMEGIRRPDQALLPELPGLGLRAPLKKTTAEQAEEDLLQEAQALAEVLDLQDREPRSSRRCVRLHESCLGQQVPCCDPCATCYCRFFNAFCYCRKLGTAMNPCSRT

SEQ ID NO: 3643 - protein, 132 aa, Homo sapiens
  Payload ID: 798;
  Gene Symbol: ASIP;
  Gene Name: agouti signaling prt;
  Uniprot ID:  P42127;
  ENSP ID: ENSP00000364092
MDVTRLLLATLLVFLCFFTANSHLPPEEKLRDDRSLRSNSSVNLLDVPSVSIVALNKKSKQIGRKAAEKKRSSKKEASMKKVVRPRTPLSAPCVATRNSCKPPAPACCDPCASCQCRFFRSACSCRVLSLNC

SEQ ID NO: 3644 - protein, 132 aa, Homo sapiens; identical to SEQ ID NO: 3643
  Payload ID: 798;
  Gene Symbol: ASIP;
  Gene Name: agouti signaling prt;
  Uniprot ID:  P42127;
  ENSP ID: ENSP00000454804

SEQ ID NO: 3645 - protein, 2045 aa, Homo sapiens
  Payload ID: 799;
  Gene Symbol: AGRN;
  Gene Name: agrin;
  Uniprot ID:  O00468;
  ENSP ID: ENSP00000368678
MAGRSHPGPLRPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 3646 - protein, 271 aa, Homo sapiens
  Payload ID: 799;
  Gene Symbol: AGRN;
  Gene Name: agrin;
  ENSP ID: ENSP00000400771
  MOD_RES (1)..(1): Any amino acid
XRYDLGKGAAVIRSREPVTLGAWTRVSLERNGRKGALRVGDGPRVLGESPKSRKVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESELANEIPVPETLDSGALHSEKALQSNHFELSLRTEATQGLVLWSGKATERADYVALAIVDGHLQLSYNLGSQPVVLRSTVPVNT

SEQ ID NO: 3647 - protein, 1930 aa, Homo sapiens
  Payload ID: 799;
  Gene Symbol: AGRN;
  Gene Name: agrin;
  ENSP ID: ENSP00000484607
MRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPKSRKVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESELANEIPVPETLDSGALHSEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 3648 - protein, 338 aa, Homo sapiens
  Payload ID: 800;
  Gene Symbol: AHSA1;
  Gene Name: AHA1, activator of heat shock 90kDa prt ATPase homolog 1 (yeast);
  Uniprot ID:  O95433;
  ENSP ID: ENSP00000216479
MAKWGEGDPRWIVEERADATNVNNWHWTERDASNWSTDKLKTLFLAVQVQNEEGKCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVPEKHIVMKWRFKSWPEGHFATITLTFIDKNGETELCMEGRGIPAPEEERTRQGWQRYYFEGIKQTFGYGARLF

SEQ ID NO: 3649 - protein, 288 aa, Homo sapiens
  Payload ID: 800;
  Gene Symbol: AHSA1;
  Gene Name: AHA1, activator of heat shock 90kDa prt ATPase homolog 1 (yeast);
  Uniprot ID:  O95433;
  ENSP ID: ENSP00000440108
MAKWGEGDPRWIVEERADATNVNNWHWTERDASNWSTDKLKTLFLAVQVQNEEGKCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVPEKHIVMKWRFKSWPEGSHCHSG

SEQ ID NO: 3650 - protein, 90 aa, Homo sapiens
  Payload ID: 800;
  Gene Symbol: AHSA1;
  Gene Name: AHA1, activator of heat shock 90kDa prt ATPase homolog 1 (yeast);
  ENSP ID: ENSP00000450890
  MOD_RES (1)..(1): Any amino acid
XVGVKIPTCKITLKETFLTSPEELYRVFTTQELVQAFTHAPATLEADRGGKFHMVDGNVSGEFTDLVPEKHIVMKWRFKSWPEGSHCHSG

SEQ ID NO: 3651 - protein, 100 aa, Homo sapiens
  Payload ID: 800;
  Gene Symbol: AHSA1;
  Gene Name: AHA1, activator of heat shock 90kDa prt ATPase homolog 1 (yeast);
  ENSP ID: ENSP00000451467
MAKWGEGDPRWIVEERADATNVNNWHWTERDASNWSTDKLKTLFLAVQVQNEEGKCEVTEVSKLDGEASINNRKGKLIFFYEWSVKLNWTGKSKLGCQRD

SEQ ID NO: 3652 - protein, 216 aa, Homo sapiens
  Payload ID: 800;
  Gene Symbol: AHSA1;
  Gene Name: AHA1, activator of heat shock 90kDa prt ATPase homolog 1 (yeast);
  ENSP ID: ENSP00000451475
  MOD_RES (1)..(1): Any amino acid
XCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVSTCRP

SEQ ID NO: 3653 - protein, 203 aa, Homo sapiens
  Payload ID: 800;
  Gene Symbol: AHSA1;
  Gene Name: AHA1, activator of heat shock 90kDa prt ATPase homolog 1 (yeast);
  ENSP ID: ENSP00000451569
MKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVPEKHIVMKWRFKSWPEGHFATITLTFIDKNGETELCMEGRGIPAPEEERTRQGWQRYYFEGIKQTFGYGARLF

SEQ ID NO: 3654 - protein, 133 aa, Homo sapiens
  Payload ID: 800;
  Gene Symbol: AHSA1;
  Gene Name: AHA1, activator of heat shock 90kDa prt ATPase homolog 1 (yeast);
  ENSP ID: ENSP00000452127
  MOD_RES (1)..(1): Any amino acid
XWSVKLNWTGTSKSGVQYKGHVEIPNLSDENSVDEVEISVSLAKDEPDTNLVALMKEEGVKLLREAMGIYISTLKTGHFATITLTFIDKNGETELCMEGRGIPAPEEERTRQGWQRYYFEGIKQTFGYGARLF

SEQ ID NO: 3655 - protein, 137 aa, Homo sapiens
  Payload ID: 801;
  Gene Symbol: AHSA2;
  Gene Name: AHA1, activator of heat shock 90kDa prt ATPase homolog 2 (yeast);
  Uniprot ID:  Q719I0;
  ENSP ID: ENSP00000349525
MILPTKAMATQELTVKRKLSGNTLQVQASSPVALGVRIPTVALHMMELFDTTVEQLYSIFTVKELTNKKIIMKWRCGNWPEEHYAMVALNFVPTLGQTELQLKEFLSICKEENMKFCWQKQHFEEIKGSLQLTPLNG

SEQ ID NO: 3656 - protein, 137 aa, Homo sapiens; identical to SEQ ID NO: 3655
  Payload ID: 801;
  Gene Symbol: AHSA2;
  Gene Name: AHA1, activator of heat shock 90kDa prt ATPase homolog 2 (yeast);
  Uniprot ID:  Q719I0;
  ENSP ID: ENSP00000377970

SEQ ID NO: 3657 - protein, 146 aa, Homo sapiens
  Payload ID: 801;
  Gene Symbol: AHSA2;
  Gene Name: AHA1, activator of heat shock 90kDa prt ATPase homolog 2 (yeast);
  ENSP ID: ENSP00000386721
MILPTKAMATQELTVKRKLSGNTLQVQASSPVALGVRIPTVALHMMELFDTTVEQLYSIFTVKEEERVCVLFSLTNKKIIMKWRCGNWPEEHYAMVALNFVPTLGQTELQLKEFLSICKEENMKFCWQKQHFEEIKGSLQLTPLNG

SEQ ID NO: 3658 - protein, 149 aa, Homo sapiens
  Payload ID: 802;
  Gene Symbol: AHNAK;
  Gene Name: AHNAK nucleoprt;
  Uniprot ID:  Q09666;
  ENSP ID: ENSP00000257247
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLNTPQPSALECKDQNKQKEASSQAGAVSVSTPNAGL

SEQ ID NO: 3659 - protein, 5890 aa, Homo sapiens
  Payload ID: 802;
  Gene Symbol: AHNAK;
  Gene Name: AHNAK nucleoprt;
  Uniprot ID:  Q09666;
  ENSP ID: ENSP00000367263
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLSGDDEEYQRIYTTKIKPRLKSEDGVEGDLGETQSRTITVTRRVTAYTVDVTGREGAKDIDISSPEFKIKIPRHELTEISNVDVETQSGKTVIRLPSGSGAASPTGSAVDIRAGAISASGPELQGAGHSKLQVTMPGIKVGGSGVNVNAKGLDLGGRGGVQVPAVDISSSLGGRAVEVQGPSLESGDHGKIKFPTMKVPKFGVSTGREGQTPKAGLRVSAPEVSVGHKGGKPGLTIQAPQLEVSVPSANIEGLEGKLKGPQITGPSLEGDLGLKGAKPQGHIGVDASAPQIGGSITGPSVEVQAPDIDVQGPGSKLNVPKMKVPKFSVSGAKGEETGIDVTLPTGEVTVPGVSGDVSLPEIATGGLEGKMKGTKVKTPEMIIQKPKISMQDVDLSLGSPKLKGDIKVSAPGVQGDVKGPQVALKGSRVDIETPNLEGTLTGPRLGSPSGKTGTCRISMSEVDLNVAAPKVKGGVDVTLPRVEGKVKVPEVDVRGPKVDVSAPDVEAHGPEWNLKMPKMKMPTFSTPGAKGEGPDVHMTLPKGDISISGPKVNVEAPDVNLEGLGGKLKGPDVKLPDMSVKTPKISMPDVDLHVKGTKVKGEYDVTVPKLEGELKGPKVDIDAPDVDVHGPDWHLKMPKMKMPKFSVPGFKAEGPEVDVNLPKADVDISGPKIDVTAPDVSIEEPEGKLKGPKFKMPEMNIKVPKISMPDVDLHLKGPNVKGEYDVTMPKVESEIKVPDVELKSAKMDIDVPDVEVQGPDWHLKMPKMKMPKFSMPGFKAEGPEVDVNLPKADVDISGPKVGVEVPDVNIEGPEGKLKGPKFKMPEMNIKAPKISMPDVDLHMKGPKVKGEYDMTVPKLEGDLKGPKVDVSAPDVEMQGPDWNLKMPKIKMPKFSMPSLKGEGPEFDVNLSKANVDISAPKVDTNAPDLSLEGPEGKLKGPKFKMPEMHFRAPKMSLPDVDLDLKGPKMKGNVDISAPKIEGEMQVPDVDIRGPKVDIKAPDVEGQGLDWSLKIPKMKMPKFSMPSLKGEGPEVDVNLPKADVVVSGPKVDIEAPDVSLEGPEGKLKGPKFKMPEMHFKTPKISMPDVDLHLKGPKVKGDVDVSVPKVEGEMKVPDVEIKGPKMDIDAPDVEVQGPDWHLKMPKMKMPKFSMPGFKGEGREVDVNLPKADIDVSGPKVDVEVPDVSLEGPEGKLKGPKFKMPEMHFKAPKISMPDVDLNLKGPKLKGDVDVSLPEVEGEMKVPDVDIKGPKVDISAPDVDVHGPDWHLKMPKVKMPKFSMPGFKGEGPEVDVKLPKADVDVSGPKMDAEVPDVNIEGPDAKLKGPKFKMPEMSIKPQKISIPDVGLHLKGPKMKGDYDVTVPKVEGEIKAPDVDIKGPKVDINAPDVEVHGPDWHLKMPKVKMPKFSMPGFKGEGPEVDMNLPKADLGVSGPKVDIDVPDVNLEAPEGKLKGPKFKMPSMNIQTHKISMPDVGLNLKAPKLKTDVDVSLPKVEGDLKGPEIDVKAPKMDVNVGDIDIEGPEGKLKGPKFKMPEMHFKAPKISMPDVDLHLKGPKVKGDMDVSVPKVEGEMKVPDVDIKGPKVDIDAPDVEVHDPDWHLKMPKMKMPKFSMPGFKAEGPEVDVNLPKADIDVSGPSVDTDAPDLDIEGPEGKLKGSKFKMPKLNIKAPKVSMPDVDLNLKGPKLKGEIDASVPELEGDLRGPQVDVKGPFVEAEVPDVDLECPDAKLKGPKFKMPEMHFKAPKISMPDVDLHLKGPKVKGDADVSVPKLEGDLTGPSVGVEVPDVELECPDAKLKGPKFKMPDMHFKAPKISMPDVDLHLKGPKVKGDVDVSVPKLEGDLTGPSVGVEVPDVELECPDAKLKGPKFKMPEMHFKTPKISMPDVDLHLKGPKVKGDMDVSVPKVEGEMKVPDVDIKGPKMDIDAPDVDVHGPDWHLKMPKMKMPKFSMPGFKAEGPEVDVNLPKADVVVSGPKVDVEVPDVSLEGPEGKLKGPKLKMPEMHFKAPKISMPDVDLHLKGPKVKGDVDVSLPKLEGDLTGPSVDVEVPDVELECPDAKLKGPKFKMPEMHFKTPKISMPDVNLNLKGPKVKGDMDVSVPKVEGEMKVPDVDIRGPKVDIDAPDVDVHGPDWHLKMPKMKMPKFSMPGFKGEGPEVDVNLPKADVDVSGPKVDVEVPDVSLEGPEGKLKGPKFKMPEMHFKTPKISMPDVDFNLKGPKIKGDVDVSAPKLEGELKGPELDVKGPKLDADMPEVAVEGPNGKWKTPKFKMPDMHFKAPKISMPDLDLHLKSPKAKGEVDVDVPKLEGDLKGPHVDVSGPDIDIEGPEGKLKGPKFKMPDMHFKAPNISMPDVDLNLKGPKIKGDVDVSVPEVEGKLEVPDMNIRGPKVDVNAPDVQAPDWHLKMPKMKMPKFSMPGFKAEGPEVDVNLPKADVDISGPKVDIEGPDVNIEGPEGKLKGPKLKMPEMNIKAPKISMPDFDLHLKGPKVKGDVDVSLPKVEGDLKGPEVDIKGPKVDINAPDVGVQGPDWHLKMPKVKMPKFSMPGFKGEGPDGDVKLPKADIDVSGPKVDIEGPDVNIEGPEGKLKGPKFKMPEMNIKAPKISMPDIDLNLKGPKVKGDVDVSLPKVEGDLKGPEVDIKGPKVDIDAPDVDVHGPDWHLKMPKIKMPKISMPGFKGEGPDVDVNLPKADIDVSGPKVDVECPDVNIEGPEGKWKSPKFKMPEMHFKTPKISMPDIDLNLTGPKIKGDVDVTGPKVEGDLKGPEVDLKGPKVDIDVPDVNVQGPDWHLKMPKMKMPKFSMPGFKAEGPEVDVNLPKADVDVSGPKVDVEGPDVNIEGPEGKLKGPKFKMPEMNIKAPKIPMPDFDLHLKGPKVKGDVDISLPKVEGDLKGPEVDIRGPQVDIDVPDVGVQGPDWHLKMPKVKMPKFSMPGFKGEGPDVDVNLPKADLDVSGPKVDIDVPDVNIEGPEGKLKGPKFKMPEMNIKAPKISMPDIDLNLKGPKVKGDMDVSLPKVEGDMKVPDVDIKGPKVDINAPDVDVQGPDWHLKMPKIKMPKISMPGFKGEGPEVDVNLPKADLDVSGPKVDVDVPDVNIEGPDAKLKGPKFKMPEMNIKAPKISMPDLDLNLKGPKMKGEVDVSLANVEGDLKGPALDIKGPKIDVDAPDIDIHGPDAKLKGPKLKMPDMHVNMPKISMPEIDLNLKGSKLKGDVDVSGPKLEGDIKAPSLDIKGPEVDVSGPKLNIEGKSKKSRFKLPKFNFSGSKVQTPEVDVKGKKPDIDITGPKVDINAPDVEVQGKVKGSKFKMPFLSISSPKVSMPDVELNLKSPKVKGDLDIAGPNLEGDFKGPKVDIKAPEVNLNAPDVDVHGPDWNLKMPKMKMPKFSVSGLKAEGPDVAVDLPKGDINIEGPSMNIEGPDLNVEGPEGGLKGPKFKMPDMNIKAPKISMPDIDLNLKGPKVKGDVDISLPKLEGDLKGPEVDIKGPKVDINAPDVDVHGPDWHLKMPKVKMPKFSMPGFKGEGPEVDVTLPKADIDISGPNVDVDVPDVNIEGPDAKLKGPKFKMPEMNIKAPKISMPDFDLNLKGPKMKGDVVVSLPKVEGDLKGPEVDIKGPKVDIDTPDINIEGSEGKFKGPKFKIPEMHLKAPKISMPDIDLNLKGPKVKGDVDVSLPKMEGDLKGPEVDIKGPKVDINAPDVDVQGPDWHLKMPKVKMPKFSMPGFKGEGPDVDVNLPKADLDVSGPKVDIDVPDVNIEGPEGKLKGPKFKMPEMNIKAPKISMPDIDLNLKGPKVKGDMDVSLPKVEGDMQVPDLDIKGPKVDINAPDVDVRGPDWHLKMPKIKMPKISMPGFKGEGPEVDVNLPKADLDVSGPKVDVDVPDVNIEGPDAKLKGPKFKMPEMNIKAPKISMPDFDLHLKGPKVKGDVDVSLPKMEGDLKAPEVDIKGPKVDIDAPDVDVHGPDWHLKMPKVKMPKFSMPGFKGEGPEVDVNLPKADIDVSGPKVDIDTPDIDIHGPEGKLKGPKFKMPDLHLKAPKISMPEVDLNLKGPKMKGDVDVSLPKVEGDLKGPEVDIKGPKVDIDVPDVDVQGPDWHLKMPKVKMPKFSMPGFKGEGPDVDVNLPKADLDVSGPKVDIDVPDVNIEGPDAKLKGPKFKMPEMNIKAPKISMPDFDLHLKGPKVKGDVDVSLPKVEGDLKGPEVDIKGPKVDIDAPDVDVHGPDWHLKMPKVKMPKFSMPGFKGEGPDVDVTLPKADIEISGPKVDIDAPDVSIEGPDAKLKGPKFKMPEMNIKAPKISMPDIDFNLKGPKVKGDVDVSLPKVEGDLKGPEIDIKGPSLDIDTPDVNIEGPEGKLKGPKFKMPEMNIKAPKISMPDFDLHLKGPKVKGDVDVSLPKVESDLKGPEVDIEGPEGKLKGPKFKMPDVHFKSPQISMSDIDLNLKGPKIKGDMDISVPKLEGDLKGPKVDVKGPKVGIDTPDIDIHGPEGKLKGPKFKMPDLHLKAPKISMPEVDLNLKGPKVKGDMDISLPKVEGDLKGPEVDIRDPKVDIDVPDVDVQGPDWHLKMPKVKMPKFSMPGFKGEGPDVDVNLPKADIDVSGPKVDVDVPDVNIEGPDAKLKGPKFKMPEMSIKAPKISMPDIDLNLKGPKVKGDVDVTLPKVEGDLKGPEADIKGPKVDINTPDVDVHGPDWHLKMPKVKMPKFSMPGFKGEGPDVDVSLPKADIDVSGPKVDVDIPDVNIEGPDAKLKGPKFKMPEINIKAPKISIPDVDLDLKGPKVKGDFDVSVPKVEGTLKGPEVDLKGPRLDFEGPDAKLSGPSLKMPSLEISAPKVTAPDVDLHLKAPKIGFSGPKLEGGEVDLKGPKVEAPSLDVHMDSPDINIEGPDVKIPKFKKPKFGFGAKSPKADIKSPSLDVTVPEAELNLETPEISVGGKGKKSKFKMPKIHMSGPKIKAKKQGFDLNVPGGEIDASLKAPDVDVNIAGPDAALKVDVKSPKTKKTMFGKMYFPDVEFDIKSPKFKAEAPLPSPKLEGELQAPDLELSLPAIHVEGLDIKAKAPKVKMPDVDISVPKIEGDLKGPKVQANLGAPDINIEGLDAKVKTPSFGISAPQVSIPDVNVNLKGPKIKGDVPSVGLEGPDVDLQGPEAKIKFPKFSMPKIGIPGVKMEGGGAEVHAQLPSLEGDLRGPDVKLEGPDVSLKGPGVDLPSVNLSMPKVSGPDLDLNLKGPSLKGDLDASVPSMKVHAPGLNLSGVGGKMQVGGDGVKVPGIDATTKLNVGAPDVTLRGPSLQGDLAVSGDIKCPKVSVGAPDLSLEASEGSIKLPKMKLPQFGISTPGSDLHVNAKGPQVSGELKGPGVDVNLKGPRISAPNVDFNLEGPKVKGSLGATGEIKGPTVGGGLPGIGVQGLEGNLQMPGIKSSGCDVNLPGVNVKLPTGQISGPEIKGGLKGSEVGFHGAAPDISVKGPAFNMASPESDFGINLKGPKIKGGADVSGGVSAPDISLGEGHLSVKGSGGEWKGPQVSSALNLDTSKFAGGLHFSGPKVEGGVKGGQIGLQAPGLSVSGPQGHLESGSGKVTFPKMKIPKFTFSGRELVGREMGVDVHFPKAEASIQAGAGDGEWEESEVKLKKSKIKMPKFNFSKPKGKGGVTGSPEASISGSKGDLKSSKASLGSLEGEAEAEASSPKGKFSLFKSKKPRHRSNSFSDEREFSGPSTPTGTLEFEGGEVSLEGGKVKGKHGKLKFGTFGGLGSKSKGHYEVTGSDDETGKLQGSGVSLASKKSRLSSSSSNDSGNKVGIQLPEVELSVSTKKE

SEQ ID NO: 3660 - protein, 144 aa, Homo sapiens
  Payload ID: 802;
  Gene Symbol: AHNAK;
  Gene Name: AHNAK nucleoprt;
  ENSP ID: ENSP00000433286
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLSGDDEEYQRIYTTKIKPRLKSEDGVEGDLG

SEQ ID NO: 3661 - protein, 121 aa, Homo sapiens
  Payload ID: 802;
  Gene Symbol: AHNAK;
  Gene Name: AHNAK nucleoprt;
  ENSP ID: ENSP00000433635
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLNTPQPSA

SEQ ID NO: 3662 - protein, 131 aa, Homo sapiens
  Payload ID: 802;
  Gene Symbol: AHNAK;
  Gene Name: AHNAK nucleoprt;
  ENSP ID: ENSP00000433789
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLDCRSGQEENHPLLRLFL

SEQ ID NO: 3663 - protein, 123 aa, Homo sapiens
  Payload ID: 802;
  Gene Symbol: AHNAK;
  Gene Name: AHNAK nucleoprt;
  ENSP ID: ENSP00000435357
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLSGDDEEYQR

SEQ ID NO: 3664 - protein, 85 aa, Homo sapiens
  Payload ID: 802;
  Gene Symbol: AHNAK;
  Gene Name: AHNAK nucleoprt;
  ENSP ID: ENSP00000436845
MEKEETTRELLLPNWQGSGSHGLTIAQRDDGVFVQEVTQNSPAARTGVVKEGDQIVGATIYFDNLQSGEVTQLLNTMGHHTVGLK

SEQ ID NO: 3665 - protein, 5795 aa, Homo sapiens
  Payload ID: 803;
  Gene Symbol: AHNAK2;
  Gene Name: AHNAK nucleoprt 2;
  Uniprot ID:  Q8IVF2;
  ENSP ID: ENSP00000353114
MCDCFHMVLPTWPGTPGSVSGRQLQPGEPGAETEDDHSVTEGPADEGIRPRPQGSSPVYEYTTEAADFGLQEDAPGRQGSAGRRRSWWKRDSGDSRTFFRMSRPEAVQEATEVTLKTEVEAGASGYSVTGGGDQGIFVKQVLKDSSAAKLFNLREGDQLLSTTVFFENIKYEDALKILQYSEPYKVQFKIRRQLPAPQDEEWASSDAQHGPQGKEKEDTDVADGCRETPTKTLEGDGDQERLISKPRVGRGRQSQRERLSWPKFQSIKSKRGPGPQRSHSSSEAYEPRDAHDVSPTSTDTEAQLTVERQEQKAGPGSQRRRKFLNLRFRTGSGQGPSSTGQPGRGFQSGVGRAGVLEELGPWGDSLEETGAATGSRREERAEQDREVMPAQSMPLPTELGDPRLCEGTPQEGGLRAARLHGKTLEGQAQETAVAQRKPRAQPTPGMSREGEGEGLQSLEIGIARLSLRDTTEGGTQIGPPEIRVRVHDLKTPKFAFSTEKEPERERRLSTPQRGKRQDASSKAGTGLKGEEVEGAGWMPGREPTTHAEAQGDEGDGEEGLQRTRITEEQDKGREDTEGQIRMPKFKIPSLGWSPSKHTKTGREKATEDTEQGREGEATATADRREQRRTEEGLKDKEDSDSMTNTTKIQLIHDEKRLKKEQILTEKEVATKDSKFKMPKFKMPLFGASAPGKSMEASVDVSAPKVEADVSLLSMQGDLKTTDLSVQTPSADLEVQDGQVDVKLPEGPLPEGASLKGHLPKVQRPSLKMPKVDLKGPKLDLKGPKAEVTAPDVKMSLSSMEVDVQAPRAKLDGARLEGDLSLADKEVTAKDSKFKMPKFKMPSFGVSAPGKSMEDSVDVSAPKVEADVSLSSMQGDLKATDLSIQPPSADLEVQAGQVDVKLPEGPVPEGAGPKVHLPKVEMPSFKMPKVDLKGPQIDVKGPKLDLKGPKAEVTAPDGEVSLPSMEVDVQAQKAKLDGAWLEGDLSLADKDVTAKDSKFKMPKFKMPSFGVSAPGKSIKALVDVSAPKVEADLSLPSMQGDLKTTDLSIQPASTDLKVQADQVDVKLPEGHLPEGAGLKGHLPKVEMPSFKMPKVALKGPQVDVKGPKLDLKSPKAEVTAPDVEVSLPSVEVDVEAPGAKLDSARLEGELSLADKDVTAKDSRFKMPKFKMPSFGASAPGKSIEASVDVSAPKVEADVSLPSMQGDLKTTDLSIQPPSADLEVHAGQVDVKLLEGHVPEGAGFKGHLPKVQMPSLKMPKVDLKGPQVEVRGPKLDLKGHKAEVTAHEVAVSLPSVEVDMQAPGAKLDGAQLDGDLSLADKDVTAKDSKFKMPKFKMPSFGVSAPGKSIEASVDLSAPKVEADMSLPSMQGDLKTTDLSIQPPSTDLELQAGQLDVKLPEGPVPEGAGLKGHLPKLQMPSFKVPKVDLKGPEIDIKGPKLDLKDPKVEVTAPDVEVSLPSVEVDVEAPGAKLDGGRLEEDMSLADKDLTTKDSKFKMPKFKMPSFGVSAPGKSIEASVDVSAPKVEADVSLPSMQGDLKATDLSIQPPSADLEVQAGQVDVKLPEGPVSEGAGLKGHLPKVQMPSFKMPKVDLKGPQIDVKGPKLDLKGPKVEVTAPDVKMSLSSMEVDVQAPRAKLDGAQLEGDLSLADKAVTAKDSKFKMPKFKMPSFGVSAPGKSIEASVDVSEPKVEADVSLPSMQGDLKTTDLSIQSPSADLEVQAGQVNVKLPEGPLPEGAGFKGHLPKVQMPSLKMPKVALKGPQMDVKGPKLDLKGPKAEVMAPDVEVSLPSVEVDVEAPGAKLDSVRLEGDLSLADKDVTAKDSKFKMPKFKMPSFGVSAPGKSIEASVDVSAPKVEAEVSLPSMQGDLKTTDLCIPLPSADLVVQAGQVDMKLPEGQVPEGAGLKGHLPKVDMPSFKMPKVDLKGPQTDVKGAKLDLKGPKAEVTAPDVEVSLPSMEVDVQAQKAKLDGARLEGDLSLADKDMTAKDSKFKMPKFKMPSFGVSAPGRSIEASVDVPAPKVEADVSLPSMQGDLKTTDLSIQPPSADLKVQTGQVDVKLPEGHVPEGAGLKGHLPKVEMPSLKMPKVDLKGPQVDIKGPKLDLKDPKVEMRVPDVEVSLPSMEVDVQAPRAKLDSAHLQGDLTLANKDLTTKDSKFKMPKFKMPSFGVSAPGKSIEASVDVSPPKVEADMSLPSMQGDLKTTDLSIQPLSADVKVQAGQVDVKLLEGPVPEEVGLKGHLPKLQMPSFKVPKVDLKGPEIDIKGPKLDLKDPKVEVTAPDVEVSLPSVEVDVKAPGAKLDGARLEGDMSLADKDVTAKDSKFKMPKFKMLSFGVSALGKSIEASADVSALKVEADVSLPSMQGDLKTTDLSVQPPSADLEVQAGQVDVKLPEGPVPEGAGLKGHLPKLQMPSFKMPKVDLKGPQIDVKGPKLDLKGPKTDVMAPDVEVSQPSVEVDVEAPGAKLDGAWLEGDLSVADKDVTTKDSRFKIPKFKMPSFGVSAPGKSIEASVDVSAPKVEADGSLSSMQGDLKATDLSIQPPSADLEVQAGQVDVKLPEGPVPEGAGLKGHLPKVQMPSFKMPEMDLKGPQLDVKGPKLDLKGPKAEVTAPDVEMSLSSMEVDVQAPRAKLDGARLEGDLSLADKGVTAKDSKFKMPKFKMPSFRVSAPGESIEALVDVSELKVEADMSLPSMQGDLKTTDISIQPPSAQLEVQAGQVDVKLPEGHVPEGAGLKGHLPKLQMPSFKMPEVDLKGPQIDVKGPNVDLKGPKAEVTAPDVKMSLSSMEVDVQAPRAKLDGARLEGDLSLADKGMTAKDSKFKMPKFKMPSFGVSAPGKSIEASVDVSELKVEADGSFPSMQGDLKTTDIRIQPPSAQLEVQAGQVDVKLPEGHVPEGAGLKGHLPKVQMPSFKMPKVDLKGPQIDVKGPKLDLKGPKAEVTAPDVEVSLPSVEVDVEAPRAKLDGARLEGDLSLADKDVTAKDSKFKMPKFKMPSFGVSAPGKSIEVSVDVSAPKVEAEVSLPSMQGDLKTTDISIEPPSAQLEVQAGQVDLKLPEGHVPEGAGLKGHLPKLQMPSFKMPKVDRKGPQIDVKGPKLDLKGPKTDVTAPDVEVSQPGMEVDVEAPGAKLDGARLEGDLSLADKDVTAKDSKFKMPKFKMPSFGVSAPGKSIEVLVDVSAPKVEADLSLPSMQGDLKNTDISIEPPSAQLEVQAGQVDVKLPEGHVLEGAGLKGHLPKLQMPSFKMPKVDRKGPQIDIKGPKLDLKGPKMDVTAPDVEVSQPSMEVDVEAPGAKLDGARLEGDLSLADKDVTAKDSKFKMPKFKMPSYRASAPGKSIQASVDVSAPKAEADVSLPSMQGDLKTTDLSIQLPSVDLEVQAGQVDVKLPEGHVPEGAGLKGHLPKVEMPSFKMPKVDLKSPQVDIKGPKLDLKVPKAEVTVPDVEVSLPSVEVDVQAPRAKLDGARLEGDLSLAEKDVTAKDSKFKMPKFKMPSFGVSAPGRSIEASLDVSAPKVEADVSLSSMQGDLKATDLSIQPPSADLEVQAVQVDVELLEGPVPEGAGLKGHLPKVEMPSLKTPKVDLKGPQIDVKGPKLDLKGPKAEVRVPDVEVSLPSVEVDVQAPKAKLDAGRLEGDLSLADKDVTAKDSKFKMPKFKMPSFRVSAPGKSMEASVDVSAPKVEADVSLPSMQGDLKTTDLSIQPPSADLKVQAGQMDVKLPEGQVPEGAGLKEHLPKVEMPSLKMPKVDLKGPQVDIKGPKLDLKVSKAEVTAPDVEVSLPSVEVDVQAPRAKLDSAQLEGDLSLADKDVTAKDSKFKMPKFKMPSFGVSAPGKSIEASVHVSAPKVEADVSLPSMQGDLKTTDLSIQPHSADLTVQARQVDMKLLEGHVPEEAGLKGHLPKVQMPSFKMPKVDLKGPEIDIKGPKLDLKDPKVEVTAPDVEVSLPSVEVDVEAPGAKLDGARLEGDLSLADKDMTAKDSKFKMPKFKMPSFGVSAPGKSMEASVDVTAPKVEADVSLPSMQGDLKATDLSVQPPSADLEVQAGQVDVKLPEGPVPEGASLKGHLPKVQMPSFKMPKVDLKGPQIDVKGPKLDLKGPKAEVTAPDVKMSLSSMEVDVQAPRAKLDGVQLEGDLSLADKDVTAKDSKFKMPKFKMPSFGVSAPGKSMEASVDVSELKAKADVSLPSMQGDLKTTDLSIQSPSADLEVQAGQVDVKLPEGPLPKGAGLKGHLPKVQMPCLKMPKVALKGPQVDVKGPKLDLKGPKADVMTPVVEVSLPSMEVDVEAPGAKLDSVRLEGDLSLADKDMTAKDSKFKMPKFKMPSFGVSAPGKSIEASLDVSALKVEADVSLPSMQGDLKTTHLSIQPPSADLEVQAGQEDVKLPEGPVHEGAGLKGHLPKLQMPSFKVPKVDLKGPQIDVNVPKLDLKGPKVEVTSPNLDVSLPSMEVDIQAPGAKLDSTRLEGDLSLADKDVTAKDSKFKMPKFKMPSFGMLSPGKSIEVSVDVSAPKMEADMSIPSMQGDLKTTDLRIQAPSADLEVQAGQVDLKLPEGHMPEVAGLKGHLPKVEMPSFKMPKVDLKGPQVDVKGPKLDLKGPKAEVMAPDVEVSLPSVETDVQAPGSMLDGARLEGDLSLAHEDVAGKDSKFQGPKLSTSGFEWSSKKVSMSSSEIEGNVTFHEKTSTFPIVESVVHEGDLHDPSRDGNLGLAVGEVGMDSKFKKLHFKVPKVSFSSTKTPKDSLVPGAKSSIGLSTIPLSSSECSSFELQQVSACSEPSMQMPKVGFAGFPSSRLDLTGPHFESSILSPCEDVTLTKYQVTVPRAALAPELALEIPSGSQADIPLPKTECSTDLQPPEGVPTSQAESHSGPLNSMIPVSLGQVSFPKFYKPKFVFSVPQMAVPEGDLHAAVGAPVMSPLSPGERVQCPLPSTQLPSPGTCVSQGPEELVASLQTSVVAPGEAPSEDADHEGKGSPLKMPKIKLPSFRWSPKKETGPKVDPECSVEDSKLSLVLDKDEVAPQSAIHMDLPPERDGEKGRSTKPGFAMPKLALPKMKASKSGVSLPQRDVDPSLSSATAGGSFQDTEKASSDGGRGGLGATASATGSEGVNLHRPQVHIPSLGFAKPDLRSSKAKVEVSQPEADLPLPKHDLSTEGDSRGCGLGDVPVSQPCGEGIAPTPEDPLQPSCRKPDAEVLTVESPEEEAMTKYSQESWFKMPKFRMPSLRRSFRDRGGAGKLEVAQTQAPAATGGEAAAKVKEFLVSGSNVEAAMSLQLPEADAEVTASESKSSTDILRCDLDSTGLKLHLSTAGMTGDELSTSEVRIHPSKGPLPFQMPGMRLPETQVLPGEIDETPLSKPGHDLASMEDKTEKWSSQPEGPLKLKASSTDMPSQISVVNVDQLWEDSVLTVKFPKLMVPRFSFPAPSSEDDVFIPTVREVQCPEANIDTALCKESPGLWGASILKAGAGVPGEQPVDLNLPLEAPPISKVRVHIQGAQVESQEVTIHSIVTPEFVDLSVPRTFSTQIVRESEIPTSEIQTPSYGFSLLKVKIPEPHTQARVYTTMTQHSRTQEGTEEAPIQATPGVDSISGDLQPDTGEPFEMISSSVNVLGQQTLTFEVPSGHQLADSCSDEEPAEILEFPPDDSQEATTPLADEGRAPKDKPESKKSGLLWFWLPNIGFSSSVDETGVDSKNDVQRSAPIQTQPEARPEAELPKKQEKAGWFRFPKLGFSSSPTKKSKSTEDGAELEEQKLQEETITFFDARESFSPEEKEEGELIGPVGTGLDSRVMVTSAARTELILPEQDRKADDESKGSGLGPNEG

SEQ ID NO: 3666 - protein, 793 aa, Homo sapiens
  Payload ID: 803;
  Gene Symbol: AHNAK2;
  Gene Name: AHNAK nucleoprt 2;
  Uniprot ID:  Q8IVF2;
  ENSP ID: ENSP00000450998
MDLPPERDGEKGRSTKPGFAMPKLALPKMKASKSGVSLPQRDVDPSLSSATAGGSFQDTEKASSDGGRGGLGATASATGSEGVNLHRPQVHIPSLGFAKPDLRSSKAKVEVSQPEADLPLPKHDLSTEGDSRGCGLGDVPVSQPCGEGIAPTPEDPLQPSCRKPDAEVLTVESPEEEAMTKYSQESWFKMPKFRMPSLRRSFRDRGGAGKLEVAQTQAPAATGGEAAAKVKEFLVSGSNVEAAMSLQLPEADAEVTASESKSSTDILRCDLDSTGLKLHLSTAGMTGDELSTSEVRIHPSKGPLPFQMPGMRLPETQVLPGEIDETPLSKPGHDLASMEDKTEKWSSQPEGPLKLKASSTDMPSQISVVNVDQLWEDSVLTVKFPKLMVPRFSFPAPSSEDDVFIPTVREVQCPEANIDTALCKESPGLWGASILKAGAGVPGEQPVDLNLPLEAPPISKVRVHIQGAQVESQEVTIHSIVTPEFVDLSVPRTFSTQIVRESEIPTSEIQTPSYGFSLLKVKIPEPHTQARVYTTMTQHSRTQEGTEEAPIQATPGVDSISGDLQPDTGEPFEMISSSVNVLGQQTLTFEVPSGHQLADSCSDEEPAEILEFPPDDSQEATTPLADEGRAPKDKPESKKSGLLWFWLPNIGFSSSVDETGVDSKNDVQRSAPIQTQPEARPEAELPKKQEKAGWFRFPKLGFSSSPTKKSKSTEDGAELEEQKLQEETITFFDARESFSPEEKEEGELIGPVGTGLDSRVMVTSAARTELILPEQDRKADDESKGSGLGPNEG

SEQ ID NO: 3667 - protein, 226 aa, Homo sapiens
  Payload ID: 804;
  Gene Symbol: AAED1;
  Gene Name: AhpC/TSA antioxidant enzyme domain containing 1;
  Uniprot ID:  Q7RTV5;
  ENSP ID: ENSP00000364382
MAAPAPVTRQVSGAAALVPAPSGPDSGQPLAAAVAELPVLDARGQRVPFGALFRERRAVVVFVRHFLCYICKEYVEDLAKIPRSFLQEANVTLIVIGQSSYHHIEPFCKLTGYSHEIYVDPEREIYKRLGMKRGEEIASSGQSPHIKSNLLSGSLQSLWRAVTGPLFDFQGDPAQQGGTLILGPGNNIHFIHRDRNRLDHKPINSVLQLVGVQHVNFTNRPSVIHV

SEQ ID NO: 3668 - protein, 180 aa, Homo sapiens
  Payload ID: 804;
  Gene Symbol: AAED1;
  Gene Name: AhpC/TSA antioxidant enzyme domain containing 1;
  ENSP ID: ENSP00000398933
  MOD_RES (1)..(1): Any amino acid
XGPRPPRVMAAPAPVTRQHFLCYICKEYVEDLAKIPRSFLQEANVTLIVIGQSSYHHIEPFCKLTGYSHEIYVDPEREIYKRLGMKRGEEIASSGQSPHIKSNLLSGSLQSLWRAVTGPLFDFQGDPAQQGGTLILGPGNNIHFIHRDRNRLDHKPINSVLQLVGVQHVNFTNRPSVIHV

SEQ ID NO: 3669 - protein, 110 aa, Homo sapiens
  Payload ID: 804;
  Gene Symbol: AAED1;
  Gene Name: AhpC/TSA antioxidant enzyme domain containing 1;
  ENSP ID: ENSP00000412378
  MOD_RES (1)..(1): Any amino acid
XYVEDLAKIPRSFLQEANVTLIVIGQSSYHHIEPFCKLTGYSHEIYVDPEREIYKRLGMKRGEEIASSGNNIHFIHRDRNRLDHKPINSVLQLVGVQHVNFTNRPSVIHV

SEQ ID NO: 3670 - protein, 62 aa, Homo sapiens
  Payload ID: 805;
  Gene Symbol:;
  Gene Name: AJ239318.1;
  ENSP ID: ENSP00000485142
MLKIAVMEVPQSAWKTVWMEVAWSHCHVPLSLKKRHICLCARQYIHLIYVYTLVYAFCYLTF

SEQ ID NO: 3671 - protein, 538 aa, Homo sapiens
  Payload ID: 806;
  Gene Symbol: AJUBA;
  Gene Name: ajuba LIM prt;
  Uniprot ID:  Q96IF1;
  ENSP ID: ENSP00000262713
MERLGEKASRLLEKFGRRKGESSRSGSDGTPGPGKGRLSGLGGPRKSGPRGATGGPGDEPLEPAREQGSLDAERNQRGSFEAPRYEGSFPAGPPPTRALPLPQSLPPDFRLEPTAPALSPRSSFASSSASDASKPSSPRGSLLLDGAGAGGAGGSRPCSNRTSGISMGYDQRHGSPLPAGPCLFGPPLAGAPAGYSPGGVPSAYPELHAALDRLYAQRPAGFGCQESRHSYPPALGSPGALAGAGVGAAGPLERRGAQPGRHSVTGYGDCAVGARYQDELTALLRLTVGTGGREAGARGEPSGIEPSGLEEPPGPFVPEAARARMREPEAREDYFGTCIKCNKGIYGQSNACQALDSLYHTQCFVCCSCGRTLRCKAFYSVNGSVYCEEDYLFSGFQEAAEKCCVCGHLILEKILQAMGKSYHPGCFRCIVCNKCLDGIPFTVDFSNQVYCVTDYHKNYAPKCAACGQPILPSEGCEDIVRVISMDRDYHFECYHCEDCRMQLSDEEGCCCFPLDGHLLCHGCHMQRLNARQPPANYI

SEQ ID NO: 3672 - protein, 538 aa, Homo sapiens; identical to SEQ ID NO: 3671
  Payload ID: 806;
  Gene Symbol: AJUBA;
  Gene Name: ajuba LIM prt;
  Uniprot ID:  Q96IF1;
  ENSP ID: ENSP00000354491

SEQ ID NO: 3673 - protein, 121 aa, Homo sapiens
  Payload ID: 806;
  Gene Symbol: AJUBA;
  Gene Name: ajuba LIM prt;
  Uniprot ID:  Q96IF1;
  ENSP ID: ENSP00000380543
MGKSYHPGCFRCIVCNKCLDGIPFTVDFSNQVYCVTDYHKNYAPKCAACGQPILPSEGCEDIVRVISMDRDYHFECYHCEDCRMQLSDEEGCCCFPLDGHLLCHGCHMQRLNARQPPANYI

SEQ ID NO: 3674 - protein, 80 aa, Homo sapiens
  Payload ID: 806;
  Gene Symbol: AJUBA;
  Gene Name: ajuba LIM prt;
  ENSP ID: ENSP00000451649
MGKSYHPGCFRCIVCNKCLDGIPFTVDFSNQVYCVTDYHKNYAPKCAACGQPILPSEGCEDIVRVISMDRDYHFECYHCE

SEQ ID NO: 3675 - protein, 143 aa, Homo sapiens
  Payload ID: 806;
  Gene Symbol: AJUBA;
  Gene Name: ajuba LIM prt;
  ENSP ID: ENSP00000451772
  MOD_RES (1)..(1): Any amino acid
XRHSYPPALGSPGALAGAGVGAAGPLERRGAQPGRHSVTGYGDCAVGARYQDELTALLRLTVGTGGREAGARGEPSGIEPSGLEEPPGPFVPEAARARMREPEAREDYFGIMLTWSPLHGALCQARSFSPSLEVCSGEKSFYN

SEQ ID NO: 3676 - protein, 64 aa, Homo sapiens
  Payload ID: 806;
  Gene Symbol: AJUBA;
  Gene Name: ajuba LIM prt;
  ENSP ID: ENSP00000452325
MGKSYHPGCFRCIVCNKCLDGIPFTVDFSNQVYCVTDYHKNYAPKCAACGQPILPSEGCEDIVR

SEQ ID NO: 3677 - protein, 80 aa, Homo sapiens; identical to SEQ ID NO: 3674
  Payload ID: 806;
  Gene Symbol: AJUBA;
  Gene Name: ajuba LIM prt;
  ENSP ID: ENSP00000452369

SEQ ID NO: 3678 - protein, 145 aa, Homo sapiens
  Payload ID: 807;
  Gene Symbol: AKIRIN1;
  Gene Name: akirin 1;
  ENSP ID: ENSP00000362075
MACGATLKRPMEFEAALLSPGSPKRRRCAPLPGPTPGLRPPDAEPPPPFQTQTPPQSLQQPAPPGSERRLPTPGSSWMKKDQPTFTLRQVGIICERLLKDYEDKIREEYEQILNTKLAEQYESFVKFTHDQIMRRYGTRPTSYVS

SEQ ID NO: 3679 - protein, 147 aa, Homo sapiens
  Payload ID: 807;
  Gene Symbol: AKIRIN1;
  Gene Name: akirin 1;
  Uniprot ID:  Q9H9L7;
  ENSP ID: ENSP00000389866
MACGATLKRPMEFEAALLSPGSPKRRRCAPLPGPTPGLRPPDAEPPPPFQTQTPPQSLQQPAPPGSERRLPTPEQIFQNIKQEYSRYQRWRHLEVVLNQSEACASESQPHSSALTAPSSPEQYESFVKFTHDQIMRRYGTRPTSYVS

SEQ ID NO: 3680 - protein, 192 aa, Homo sapiens
  Payload ID: 807;
  Gene Symbol: AKIRIN1;
  Gene Name: akirin 1;
  Uniprot ID:  Q9H9L7;
  ENSP ID: ENSP00000392678
MACGATLKRPMEFEAALLSPGSPKRRRCAPLPGPTPGLRPPDAEPPPPFQTQTPPQSLQQPAPPGSERRLPTPEQIFQNIKQEYSRYQRWRHLEVVLNQSEACASESQPHSSALTAPSSPGSSWMKKDQPTFTLRQVGIICERLLKDYEDKIREEYEQILNTKLAEQYESFVKFTHDQIMRRYGTRPTSYVS

SEQ ID NO: 3681 - protein, 130 aa, Homo sapiens
  Payload ID: 807;
  Gene Symbol: AKIRIN1;
  Gene Name: akirin 1;
  ENSP ID: ENSP00000436372
  MOD_RES (1)..(1): Any amino acid
XPPDAEPPPPFQTQTPPQSLQQPAPPGSERRLPTPEQIFQNIKQEYSRYQRWRHLEVVLNQSEACASESQPHSSALTAPSSPGSSWMKKDQPTFTLRQVGIICERLLKDYEDKIREEYEQILNTKLADVS

SEQ ID NO: 3682 - protein, 203 aa, Homo sapiens
  Payload ID: 808;
  Gene Symbol: AKIRIN2;
  Gene Name: akirin 2;
  Uniprot ID:  Q53H80;
  ENSP ID: ENSP00000257787
MACGATLKRTLDFDPLLSPASPKRRRCAPLSAPTSAAASPLSAAAATAASFSAAAASPQKYLRMEPSPFGDVSSRLTTEQILYNIKQEYKRMQKRRHLETSFQQTDPCCTSDAQPHAFLLSGPASPGTSSAASSPLKKEQPLFTLRQVGMICERLLKEREEKVREEYEEILNTKLAEQYDAFVKFTHDQIMRRYGEQPASYVS

SEQ ID NO: 3683 - protein, 722 aa, Homo sapiens
  Payload ID: 809;
  Gene Symbol: AKNAD1;
  Gene Name: AKNA domain containing 1;
  ENSP ID: ENSP00000359011
MDEADFSEHTTYKQEDLPYDGDLSQIKIGNDYSFTSKKDGLEVLNQIIFIADDPQEKAMHSETCGNTAVTIPLGKITENAANKKDEKEKQCTAALHIPANEGDASKSSISDILLHHLSKEPFLRGQGIDCETLPEISNADSFEEEAIIKSIISCYNKNSWPKEQTPELTDQLNPKRDGENSNKPGSATTTEENTSDLEGPVAAGDSSHQENVNVLTKTKGPGDKQKSYQGQSPQKQQTEKANSGNTFKYGQGQVHYQLPDFSKIAPKVKIPKNKIINKPLAIAKQASFSSKSRDKPTLVQDSLETTPESNCVEKQHQEQKGKITEPSQQIQMEPIVHIHQELLTGIESEASLSKLSPTSQKGTSSSSSYIFQKISQGKQMCQKLKEQTDQLKTKVQEFSKRIKQDSPYHLQDKKLVLEKLQGHLELLEQNFLATKDKHLTLQQQVHKHESTIVGDFDPERKVEGEIFKLEMLLEDVKEKMDESKYTSAPSLPVSSPVTLDDLASTFSSLSNEAPNEELCELAPQTYLNGHYGDAAAQNKPDQVAMRLSSNSGEDPNGTPRRQDCAEMTAPSPSCAFCRRLLEWKQNVEKKGHGRINCGRFSIVLHEKAPHSDSTPNSDTGHSFCSDSGTEMQSNKCQDCGTKIPTSRRACRKEPTKEFHYRYNTPGQNYSNHSKRGAFVQPHSLDESKNSSPCLVHSPDTSKSSPTSGWQEAELGLENMKSQ

SEQ ID NO: 3684 - protein, 761 aa, Homo sapiens
  Payload ID: 809;
  Gene Symbol: AKNAD1;
  Gene Name: AKNA domain containing 1;
  Uniprot ID:  Q5T1N1;
  ENSP ID: ENSP00000359012
MDEADFSEHTTYKQEDLPYDGDLSQIKIGNDYSFTSKKDGLEVLNQIIFIADDPQEKAMHSETCGNTAVTIPLGKITENAANKKDEKEKQCTAALHIPANEGDASKSSISDILLHHLSKEPFLRGQGIDCETLPEISNADSFEEEAIIKSIISCYNKNSWPKEQTPELTDQLNPKRDGENSNKPGSATTTEENTSDLEGPVAAGDSSHQENVNVLTKTKGPGDKQKSYQGQSPQKQQTEKANSGNTFKYGQGQVHYQLPDFSKIAPKVKIPKNKIINKPLAIAKQASFSSKSRDKPTLVQDSLETTPESNCVEKQHQEQKGKITEPSQQIQMEPIVHIHQELLTGIESEASLSKLSPTSQKGTSSSSSYIFQKISQGKQMCQKLKEQTDQLKTKVQEFSKRIKQDSPYHLQDKKLVLEKLQGHLELLEQNFLATKDKHLTLQQQVHKHESTIVGDFDPERKVEGEIFKLEMLLEDVKEKMDESKYTSAPSLPVSSPVTLDDLASTFSSLSNEIPKEHPGHPSGPRGSGGSEVTGTPQGGPQEAPNEELCELAPQTYLNGHYGDAAAQNKPDQVAMRLSSNSGEDPNGTPRRQDCAEMTAPSPSCAFCRRLLEWKQNVEKKGHGRINCGRFSIVLHEKAPHSDSTPNSDTGHSFCSDSGTEMQSNKCQDCGTKIPTSRRACRKEPTKEFHYRYNTPGQNYSNHSKRGAFVQPHSLDESKNSSPSLASPFCCPGLVHSPDTSKSSPTSGWQEAELGLENMKSQ

SEQ ID NO: 3685 - protein, 836 aa, Homo sapiens
  Payload ID: 809;
  Gene Symbol: AKNAD1;
  Gene Name: AKNA domain containing 1;
  Uniprot ID:  Q5T1N1;
  ENSP ID: ENSP00000359018
MDEADFSEHTTYKQEDLPYDGDLSQIKIGNDYSFTSKKDGLEVLNQIIFIADDPQEKAMHSETCGNTAVTIPLGKITENAANKKDEKEKQCTAALHIPANEGDASKSSISDILLHHLSKEPFLRGQGIDCETLPEISNADSFEEEAIIKSIISCYNKNSWPKEQTPELTDQLNPKRDGENSNKPGSATTTEENTSDLEGPVAAGDSSHQENVNVLTKTKGPGDKQKSYQGQSPQKQQTEKANSGNTFKYGQGQVHYQLPDFSKIAPKVKIPKNKIINKPLAIAKQASFSSKSRDKPTLVQDSLETTPESNCVEKQHQEQKGKITEPSQQIQMEPIVHIHQELLTGIESEASLSKLSPTSQKGTSSSSSYIFQKISQGKQMCQKLKEQTDQLKTKVQEFSKRIKQDSPYHLQDKKLVLEKLQGHLELLEQNFLATKDKHLTLQQQVHKHESTIVGDFDPERKVEGEIFKLEMLLEDVKEKMDESKYTSAPSLPVSSPVTLDDLASTFSSLSNEIPKEHPGHPSGPRGSGGSEVTGTPQGGPQEAPNEELCELAPQTYLNGHYGDAAAQNKPDQVAMRLSSNSGEDPNGTPRRQDCAEMTAPSPSCAFCRRLLEWKQNVEKKGHGRINCGRFSIVLHEKAPHSDSTPNSDTGHSFCSDSGTEMQSNKCQDCGTKIPTSRRACRKEPTKEFHYRYNTPGQNYSNHSKRGAFVQPHSLDESKNSSPSFLKPKRICSQRVNSKSFKGEHEPTPGKKKLQAFMTYSSDPATPSPHFYSCRISGSKSLCDFDSTEEIKSEILNSALDHALRTATILKETTDQMIKTIAEDLAKAQRWRNRLKY

SEQ ID NO: 3686 - protein, 415 aa, Homo sapiens
  Payload ID: 809;
  Gene Symbol: AKNAD1;
  Gene Name: AKNA domain containing 1;
  Uniprot ID:  Q5T1N1;
  ENSP ID: ENSP00000432262
MDEADFSEHTTYKQEDLPYDGDLSQIKIGNDYSFTSKKDGLEVLNQIIFIADDPQEKAMHSETCGNTAVTIPLGKITENAANKKDEKEKQCTAALHIPANEGDASKSSISDILLHHLSKEPFLRGQGIDCETLPEISNADSFEEEAIIKSIISCYNKNSWPKEQTPELTDQLNPKRDGENSNKPGSATTTEENTSDLEGPVAAGDSSHQENVNVLTKTKGPGDKQKSYQGQSPQKQQTEKANSGNTFKYGQGQVHYQLPDFSKIAPKVKIPKNKIINKPLAIAKQASFSSKSRDKPTLVQDSLETTPESNCVEKQHQEQKGKITEPSQQIQMEPIVHIHQELLTGIESEASLSKLSPTSQKGTSSSSSYIFQKISQGKQMCQKLKEQTDQLKTKVQEFSKRIKQDSPYHLQDKKL

SEQ ID NO: 3687 - protein, 569 aa, Homo sapiens
  Payload ID: 809;
  Gene Symbol: AKNAD1;
  Gene Name: AKNA domain containing 1;
  ENSP ID: ENSP00000433889
MDEADFSEHTTYKQEDLPYDGDLSQIKIGNDYSFTSKKDGLEVLNQIIFIADDPQEKAMHSETCGNTAVTIPLGKITENAANKKDEKEKQCTAALHIPANEGDASKSSISDILLHHLSKEPFLRGQGIDCETLPEISNADSFEEEAIIKSIISCYNKNSWPKEQTPELTDQLNPKRDGENSNKPGSATTTEENTSDLEGPVAAGDSSHQENVNVLTKTKGPGDKQKSYQGQSPQKQQTEKANSGNTFKYGQGQVHYQLPDFSKIAPKVKIPKNKIINKPLAIAKQASFSSKSRDKPTLVQDSLETTPESNCVEKQHQEQKGKITEPSQQIQMEPIVHIHQELLTGIESEASLSKLSPTSQKGTSSSSSYIFQKISQGKQMCQKLKEQTDQLKTKVQEFSKRIKQDSPYHLQDKKLVLEKLQGHLELLEQNFLATKDKHLTLQQQVHKHESTIVGDFDPERKVEGEIFKLEMLLEDVKEKMDESKYTSAPSLPVSSPVTLDDLASTFSSLSNEIPKEHPGHPSGPRGSGGSEVTGTPQGGPQEAPNEELCELAPQTRIPTALQEGRIVQR

SEQ ID NO: 3688 - protein, 652 aa, Homo sapiens
  Payload ID: 809;
  Gene Symbol: AKNAD1;
  Gene Name: AKNA domain containing 1;
  Uniprot ID:  Q5T1N1;
  ENSP ID: ENSP00000436835
MDEADFSEHTTYKQEDLPYDGDLSQIKIGNDYSFTSKKDGLEVLNQIIFIADDPQEKAMHSETCGNTAVTIPLGKITENAANKKDEKEKQCTAALHIPANEGDASKSSISDILLHHLSKEPFLRGQGIDCETLPEISNADSFEEEAIIKSIISCYNKNSWPKEQTPELTDQLNPKRDGENSNKPGSATTTEENTSDLEGPVAAGDSSHQENVNVLTKTKGPGDKQKSYQGQSPQKQQTEKANSGNTFKYGQGQVHYQLPDFSKIAPKVKIPKNKIINKPLAIAKQASFSSKSRDKPTLVQDSLETTPESNCVEKQHQEQKGKITEPSQQIQMEPIVHIHQELLTGIESEASLSKLSPTSQKGTSSSSSYIFQKISQGKQMCQKLKEQTDQLKTKVQEFSKRIKQDSPYHLQDKKLVLEKLQGHLELLEQNFLATKDKHLTLQQQVHKHESTIVGDFDPERKVEGEIFKLEMLLEDVKEKMDESKYTSAPSLPVSSPVTLDDLASTFSSLSNEEDPNGTPRRQDCAEMTAPSPSCAFCRRLLEWKQNVEKKGHGRINCGRFSIVLHEKAPHSDSTPNSDTGHSFCSDSGTEMQSNKCQDCGTKIPTSRRACRKEPTKEFHYRYNTPGQNYSNHSKRGAFVQPHSLDESKNSSP

SEQ ID NO: 3689 - protein, 293 aa, Homo sapiens
  Payload ID: 810;
  Gene Symbol: AKTIP;
  Gene Name: AKT interacting prt;
  Uniprot ID:  Q9H8T0;
  ENSP ID: ENSP00000300245
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVYIPDNYPDGDCPRLVFDIPVFHPLVDPTSGELDVKRAFAKWRRNHNHIWQVLMYARRVFYKIDTASPLNPEAAVLYEKDIQLFKSKVVDSVKVCTARLFDQPKIEDPYAISFSPWNPSVHDEAREKMLTQKKKPEEQHNKSVHVAGLSWVKPGSVQPFSKEEKTVAT

SEQ ID NO: 3690 - protein, 292 aa, Homo sapiens
  Payload ID: 810;
  Gene Symbol: AKTIP;
  Gene Name: AKT interacting prt;
  Uniprot ID:  Q9H8T0;
  ENSP ID: ENSP00000378152
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVYIPDNYPDGDCPRLVFDIPVFHPLVDPTSGELDVKRAFAKWRRNHNHIWQVLMYARRVFYKIDTASPLNPEAAVLYEKDIQLFKSKVVDSVKVCTARLFDQPKIEDPYAISFSPWNPSVHDEAREKMLTQKKPEEQHNKSVHVAGLSWVKPGSVQPFSKEEKTVAT

SEQ ID NO: 3691 - protein, 249 aa, Homo sapiens
  Payload ID: 810;
  Gene Symbol: AKTIP;
  Gene Name: AKT interacting prt;
  ENSP ID: ENSP00000454269
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVYIPDNYPDGDCPLSRGTSVLCSSFRHAIRALFLCSGSAREAGCLPSCSTHQRLVFDIPVFHPLVDPTSGELDVKRAFAKWRRNHNHIWQVLMYARRVFYKIDTASPLNPEAAVLYEKDIQLFK

SEQ ID NO: 3692 - protein, 127 aa, Homo sapiens
  Payload ID: 810;
  Gene Symbol: AKTIP;
  Gene Name: AKT interacting prt;
  ENSP ID: ENSP00000454771
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVY

SEQ ID NO: 3693 - protein, 292 aa, Homo sapiens; identical to SEQ ID NO: 3690
  Payload ID: 810;
  Gene Symbol: AKTIP;
  Gene Name: AKT interacting prt;
  Uniprot ID:  Q9H8T0;
  ENSP ID: ENSP00000455874

SEQ ID NO: 3694 - protein, 14 aa, Homo sapiens
  Payload ID: 810;
  Gene Symbol: AKTIP;
  Gene Name: AKT interacting prt;
  ENSP ID: ENSP00000456398
MNPFWSMSTSSVRK

SEQ ID NO: 3695 - protein, 149 aa, Homo sapiens
  Payload ID: 810;
  Gene Symbol: AKTIP;
  Gene Name: AKT interacting prt;
  ENSP ID: ENSP00000456418
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVYIPDNYPDGDCPRLVFDIPVFHP

SEQ ID NO: 3696 - protein, 40 aa, Homo sapiens
  Payload ID: 810;
  Gene Symbol: AKTIP;
  Gene Name: AKT interacting prt;
  ENSP ID: ENSP00000456922
MNPFWSMSTSSVRKRSEGEEKTLTGDVKTSPPRTAPKKQL

SEQ ID NO: 3697 - protein, 136 aa, Homo sapiens
  Payload ID: 810;
  Gene Symbol: AKTIP;
  Gene Name: AKT interacting prt;
  ENSP ID: ENSP00000458118
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVYIPDNYPDGD

SEQ ID NO: 3698 - protein, 256 aa, Homo sapiens
  Payload ID: 811;
  Gene Symbol: AKT1S1;
  Gene Name: AKT1 substrate 1 (proline-rich);
  Uniprot ID:  Q96B36;
  ENSP ID: ENSP00000341698
MASGRPEELWEAVVGAAERFRARTGTELVLLTAAPPPPPRPGPCAYAAHGRGALAEAARRCLHDIALAHRAATAARPPAPPPAPQPPSPTPSPPRPTLAREDNEEDEDEPTETETSGEQLGISDNGGLFVMDEDATLQDLPPFCESDPESTDDGSLSEETPAGPPTCSVPPASALPTQQYAKSLPVSVPVWGFKEKRTEARSSDEENGPPSSPDLDRIAASMRALVLREAEDTQVFGDLPRPRLNTSDFQKLKRKY

SEQ ID NO: 3699 - protein, 108 aa, Homo sapiens
  Payload ID: 811;
  Gene Symbol: AKT1S1;
  Gene Name: AKT1 substrate 1 (proline-rich);
  ENSP ID: ENSP00000375706
MASGRPEELWEAVVGAAERFRARTGTELVLLTAAPPPPPRPGPCAYAAHGRGALAEAARRCLHDIALAHRAATAARPPAPPPAPQPPSPTPSPPRPTLAREDNEEDED

SEQ ID NO: 3700 - protein, 256 aa, Homo sapiens; identical to SEQ ID NO: 3698
  Payload ID: 811;
  Gene Symbol: AKT1S1;
  Gene Name: AKT1 substrate 1 (proline-rich);
  Uniprot ID:  Q96B36;
  ENSP ID: ENSP00000375707

SEQ ID NO: 3701 - protein, 256 aa, Homo sapiens; identical to SEQ ID NO: 3698
  Payload ID: 811;
  Gene Symbol: AKT1S1;
  Gene Name: AKT1 substrate 1 (proline-rich);
  Uniprot ID:  Q96B36;
  ENSP ID: ENSP00000375708

SEQ ID NO: 3702 - protein, 256 aa, Homo sapiens; identical to SEQ ID NO: 3698
  Payload ID: 811;
  Gene Symbol: AKT1S1;
  Gene Name: AKT1 substrate 1 (proline-rich);
  Uniprot ID:  Q96B36;
  ENSP ID: ENSP00000375709

SEQ ID NO: 3703 - protein, 256 aa, Homo sapiens; identical to SEQ ID NO: 3698
  Payload ID: 811;
  Gene Symbol: AKT1S1;
  Gene Name: AKT1 substrate 1 (proline-rich);
  Uniprot ID:  Q96B36;
  ENSP ID: ENSP00000375710

SEQ ID NO: 3704 - protein, 276 aa, Homo sapiens
  Payload ID: 811;
  Gene Symbol: AKT1S1;
  Gene Name: AKT1 substrate 1 (proline-rich);
  Uniprot ID:  Q96B36;
  ENSP ID: ENSP00000375711
MSFEGGDGAGPAMLATGTARMASGRPEELWEAVVGAAERFRARTGTELVLLTAAPPPPPRPGPCAYAAHGRGALAEAARRCLHDIALAHRAATAARPPAPPPAPQPPSPTPSPPRPTLAREDNEEDEDEPTETETSGEQLGISDNGGLFVMDEDATLQDLPPFCESDPESTDDGSLSEETPAGPPTCSVPPASALPTQQYAKSLPVSVPVWGFKEKRTEARSSDEENGPPSSPDLDRIAASMRALVLREAEDTQVFGDLPRPRLNTSDFQKLKRKY

SEQ ID NO: 3705 - protein, 33 aa, Homo sapiens
  Payload ID: 811;
  Gene Symbol: AKT1S1;
  Gene Name: AKT1 substrate 1 (proline-rich);
  ENSP ID: ENSP00000472839
MASGRPEELWEAVVGAAERFRARTGTELVLLTA

SEQ ID NO: 3706 - protein, 112 aa, Homo sapiens
  Payload ID: 812;
  Gene Symbol:;
  Gene Name: AL008723.1;
  ENSP ID: ENSP00000485273
LDPPFAVNRFSADSQVPFCACSHVHLPAVAATGKARGAQDANGHVKSLGKVLPILSDAPTSDAPEVVRNEEEVVGCVGIQGHIHCEKEKKLLSKWTETNPMPLFYFKGPNIS

SEQ ID NO: 3707 - protein, 168 aa, Homo sapiens
  Payload ID: 813;
  Gene Symbol:;
  Gene Name: AL021546.6;
  ENSP ID: ENSP00000450281
  MOD_RES (1)..(1): Any amino acid
XSSGAHGEEGSARMWKTLTFFVALPGVAVSMLNVYLKSHHGEHERPEFIAYPHLRIRTKGSGRITAAVIEHLERLALVDFGSREAVARLEKAIAFADRLRAVDTDGVEPMESVLEDRCLYLRSDNVVEGNCADELLQNSHRVVEEYFVAPPGNISLPKLDEQEPFPHS

SEQ ID NO: 3708 - protein, 243 aa, Homo sapiens
  Payload ID: 814;
  Gene Symbol:;
  Gene Name: AL022578.1;
  ENSP ID: ENSP00000485673
MEKLRKWVLWDVRYPSAAWSGGEHGRAHVALPHGIHHVGGVSIRIEDEDTSELTEQAVSLELSALNSGGAVPLVAGSTGGDVSLGGLTGGGGLWTCSLWICVIPLRETEGPLGKNQGRPRLSPGRYHRMRSGEMSGWLQASPRTYHKGRRRRRNHGYASPPRICHEVGKRENSECWVPLLLCLWGLDARFECCSNLPYLPLHLPQLKRDYVVPILIIFNVSLVQCNMSIKIFRKLYYFYFLMK

SEQ ID NO: 3709 - protein, 201 aa, Homo sapiens
  Payload ID: 815;
  Gene Symbol:;
  Gene Name: AL023806.1;
  ENSP ID: ENSP00000485232
MALTKMLIMIWTMKSRLSWSQMEMRNLLGIGAKVTRYVLAKRLVAFCPCPKDLWNFELERDDLGYLVEEVSKQQSIQEVTWVLLKAFSFIREAEHKRLENLQPDNVIEKKILFSEEKFKLAAKIWISNEELNINPQDNGENVCRACQRSSQQLLLSQTWRPRRKKWFHGLGPRPPCSVQPKDLVPCVPATPAMAKRGQGTV

SEQ ID NO: 3710 - protein, 124 aa, Homo sapiens
  Payload ID: 816;
  Gene Symbol:;
  Gene Name: AL023875.1;
  ENSP ID: ENSP00000485038
MTLNEHAAFKHLFNKAHLAPPLIHLTLSGHSTCFREHRVGGKVTDQQDPKAEEFFLVPNKMKSLPCLPLSTQTRQPSDFSIFSPPFPPFYSTKPPLSSWPVLNELLGTPPRWGGGLAEGLLTSQ

SEQ ID NO: 3711 - protein, 119 aa, Homo sapiens
  Payload ID: 817;
  Gene Symbol:;
  Gene Name: AL049794.1;
  ENSP ID: ENSP00000485558
MISEGFLTSSPSGLRTRLFLSFLSANCGSVFDFKDSGMNSSMIRTCYYCPCFTAPGIGSLILQKLHTFRALGGTGTSKESEGMKAGEMRPTLERQEERREKAPRPGTVAHACNPSTLGG

SEQ ID NO: 3712 - protein, 21 aa, Homo sapiens
  Payload ID: 818;
  Gene Symbol:;
  Gene Name: AL049872.1;
  ENSP ID: ENSP00000485197
SSIFHFPGGPPAAAAAAAVAA

SEQ ID NO: 3713 - protein, 56 aa, Homo sapiens
  Payload ID: 819;
  Gene Symbol:;
  Gene Name: AL109927.1;
  ENSP ID: ENSP00000485497
MILESGRKKGGSGRPRKEPGQSIEKDIRSLSLQCKCCEDRSLWAISTPPPIVILHG

SEQ ID NO: 3714 - protein, 124 aa, Homo sapiens [sequence omitted]

SEQ ID NO: 3715 - protein, 33 aa, Homo sapiens
  Payload ID: 821;
  Gene Symbol:;
  Gene Name: AL133475.1;
  ENSP ID: ENSP00000486845
ECKLHNTGIFVYFVHYSINSAWYILLRSLLHKL

SEQ ID NO: 3716 - protein, 124 aa, Homo sapiens [sequence omitted]

SEQ ID NO: 3717 - protein, 31 aa, Homo sapiens
  Payload ID: 823;
  Gene Symbol:;
  Gene Name: AL135842.1;
  ENSP ID: ENSP00000485213
RQSLQRRVQSPQSCGSSWSPQTAGHCHCHSS

SEQ ID NO: 3718 - protein, 124 aa, Homo sapiens [sequence omitted]

SEQ ID NO: 3719 - protein, 23 aa, Homo sapiens
  Payload ID: 825;
  Gene Symbol:;
  Gene Name: AL137164.1;
  ENSP ID: ENSP00000485746
EYQKYIIMSDIPVCSKQKTQIHF

SEQ ID NO: 3720 - protein, 124 aa, Homo sapiens; identical to SEQ ID NO: 1098
  Payload ID: 826;
  Gene Symbol:;
  Gene Name: AL137860.1;
  ENSP ID: ENSP00000485435

SEQ ID NO: 3721 - protein, 19 aa, Homo sapiens
  Payload ID: 827;
  Gene Symbol:;
  Gene Name: AL138706.2;
  ENSP ID: ENSP00000485148
LVQLVVTCKYLLHFSSSET

SEQ ID NO: 3722 - protein, 11 aa, Homo sapiens
  Payload ID: 828;
  Gene Symbol:;
  Gene Name: AL138751.1;
  ENSP ID: ENSP00000486495
ISTKKGKVTRS

SEQ ID NO: 3723 - protein, 18 aa, Homo sapiens
  Payload ID: 829;
  Gene Symbol:;
  Gene Name: AL139333.1;
  ENSP ID: ENSP00000487357
STVLALKDRLSLFCPGWS

SEQ ID NO: 3724 - protein, 19 aa, Homo sapiens
  Payload ID: 830;
  Gene Symbol:;
  Gene Name: AL158839.1;
  ENSP ID: ENSP00000485251
LEEIYSQPNFTEDLLRAVL

SEQ ID NO: 3725 - protein, 18 aa, Homo sapiens
  Payload ID: 831;
  Gene Symbol:;
  Gene Name: AL162426.1;
  ENSP ID: ENSP00000485384
SRSRRSCRPWGRLLGRLG

SEQ ID NO: 3726 - protein, 243 aa, Homo sapiens
  Payload ID: 832;
  Gene Symbol:;
  Gene Name: AL354822.1;
  ENSP ID: ENSP00000480106
MRSAAFTIPSLKQRSPRCSTGRAELGKGEPSPCTGRPEQRGRRKSSLAPPAPTPDAGPQTSKDLEPPPHGCQEADRGGSWGATTSRPFRQNLSDLGRHSVLPLKRNLCPGGSSLGAPPLRTPQRRVTLAAQRWLSRPQRRAVGLGELDQGAQLAALGLRWGVDSLGGCPRASQPAGHSGLHHTLTCLRRHLALQAGASGHAGQLPQRASAAWEQQGQSYTALHLAAMYLGDGEAASGNIGRRC

SEQ ID NO: 3727 - protein, 404 aa, Homo sapiens
  Payload ID: 833;
  Gene Symbol:;
  Gene Name: AL354828.1;
  ENSP ID: ENSP00000485488
IFLRVSSSDKQLDFLLQAKINKSQRFPRRQNVPILWHRCSLPTHIRTQRWNVLISNLLCISYQTMGFFSLSFLFLCFLRDLLKTEVLLKSNENHNGNLKVPDVRVMLECSGAISAHCKLRLPGSRHSPASASRVAGTTGAHHHARLIFCIFSRGRVSPCYHKVRRSRAFWLTRENHPKKYKTKLAGRGGGRLPATREAEAGEWREPRRQSLQRRSGHCTPAWATGRDSISKKVGQHCRKQRATDCLKVDVGQAQWLMPVIPALLGGQGSQITRDQSGKHSETPSLLKIQKISRVWQCAPVIPATREAEAGESREPRRRRLQPRSQHCTPAQVTTMHGSRIYMAKEGEVGMGWGEDKILLPVTHITPPPPLLSSTSSLPTPTNTITAIITTITINTKTETTTTTT

SEQ ID NO: 3728 - protein, 227 aa, Homo sapiens
  Payload ID: 834;
  Gene Symbol:;
  Gene Name: AL354828.2;
  ENSP ID: ENSP00000485090
RLECSGLISAHCKLCLLGSRHSPASASRVAGTIGAHHHAQLIFCIFSRDGVSPCYHEVSRSRPSWLTRCTYIRKYKKLAGRGGGRLPATREAEAGEWREPGRRSLQPRSRHCTPAWATERDSVSIKKKDHGRLQNKEDTLKLCSGKVRWSMPVISLNTGGKATALRMSGAGSALHGETPSLLKIQKISWAWWQAPVVPAAGEAEAGEWREPRRRSLHERRLRHCTPA

SEQ ID NO: 3729 - protein, 170 aa, Homo sapiens
  Payload ID: 835;
  Gene Symbol:;
  Gene Name: AL356131.3;
  ENSP ID: ENSP00000489278
MGKDIMNKTPKAMATKARIDKWDLIKLKSFCTAKETIIRTNRQPTEWEKFLAIYPSDKGLISRIYMDKNRNYKKLKSRVTKQRVQPMKVDLKWDKKGRERLLRPVIPALWEAEAGRSPEARSWRPPWPTWQNPVSTKNTKISWVWWQLPVIAATREAKAGEWIEPGRQRL

SEQ ID NO: 3730 - protein, 11 aa, Homo sapiens
  Payload ID: 836;
  Gene Symbol:;
  Gene Name: AL356135.1;
  ENSP ID: ENSP00000485371
MARRKLSCFLI

SEQ ID NO: 3731 - protein, 190 aa, Homo sapiens
  Payload ID: 837;
  Gene Symbol:;
  Gene Name: AL356289.1;
  ENSP ID: ENSP00000485411
MCLCVCLYVCICVYVCVCHFVCFWVCLPLRVSVYLYLRVCVCVCVFVCLCMCVRGCVSVCVCVCIEREGERKGATDGSAWKVYPHSQPWEESVNPPTGQDQLWWCLADSGNVTFHLRMGLHFLGKECRSWSLKECFFFPFVIERAQPCVHWLTVTNLRVGDSHREETEGTADSEQESGGTSLPLGPNPQL

SEQ ID NO: 3732 - protein, 299 aa, Homo sapiens
  Payload ID: 838;
  Gene Symbol:;
  Gene Name: AL356585.2;
  ENSP ID: ENSP00000486163
SQTLASAQAPVQTPAPTLPGPALPGPFPGGRVVRLHPVLLASTVDSYERRNKGAARVIGTLLGTVNKHSVEVTNCFSVSYNESDEVVVDMEFAKNMYELHKKVSPNELILGWYAAGHDITEHSVLIHEYYSREAPNPIHLTVDTSLQNGHMSIKAYVSTLMGVPGRTVGVFTPLTVKYAYYDTECIRVDLIMKTCFSPNRVVGLSSDLQQVGGASAHIQDALSIVLQYAEDILSAKVSADNTIRKVGHFLMSLVNQVPKIVPDDFETMLHSNINDLLMVAYLANLTQSQIALNEKRVNL

SEQ ID NO: 3733 - protein, 299 aa, Homo sapiens; identical to SEQ ID NO: 3732
  Payload ID: 839;
  Gene Symbol:;
  Gene Name: AL356585.3;
  ENSP ID: ENSP00000485744

SEQ ID NO: 3734 - protein, 127 aa, Homo sapiens [sequence omitted]

SEQ ID NO: 3735 - protein, 182 aa, Homo sapiens
  Payload ID: 841;
  Gene Symbol:;
  Gene Name: AL358852.1;
  ENSP ID: ENSP00000485235
MQPAKSGPERAGSARQSKPLDPRQRGWAWAPAATAPPTRALEERTRYASPGPTWRGEQSSWTAATGLRADAEAARVRPSNPKYPWWGRAGRRTGGLPRASAARPRGREDLALPLTPGHRRRRRHFAFHSVSPPPHSAAGFPDVGISRRRLRGGRGLGAFARPAAARERAACGLRASLRRPQL

SEQ ID NO: 3736 - protein, 182 aa, Homo sapiens
  Payload ID: 842;
  Gene Symbol:;
  Gene Name: AL360294.1;
  ENSP ID: ENSP00000485122
MKSSEELQCLKQMEEELLFLKAGQGSQRARLTPPLPRALQGNFGAPALCGIWFAEHLHPAVGMPPNYNSSMLSLSPERTILSGGWSGKQTQQPVPPLRTLLLRSPFSLHKSSQPGSPKASQRIHPLFHSIPRSQLHSVLLGLPLLFIQTRPSPPAQYGAQMPLRYICFGPNIFWGSKKPQKE

SEQ ID NO: 3737 - protein, 139 aa, Homo sapiens
  Payload ID: 843;
  Gene Symbol:;
  Gene Name: AL365181.2;
  ENSP ID: ENSP00000485562
MSSECLPHLPSRVPSPTHANLPHKAPPTQASCHSTHLTLGYTLYLSEDLLAHFFLVPLHIVPCLCVSLNYLFLQILLVESPYLFFPPLVLPTTTSSLSTVKFLPFFPFLGKLEIFFCKFPFKLAFPPLIKWTTWGGNPG

SEQ ID NO: 3738 - protein, 98 aa, Homo sapiens
  Payload ID: 844;
  Gene Symbol:;
  Gene Name: AL365202.1;
  ENSP ID: ENSP00000485257
LFIKKSLALLPRLEYSGTILAHCNLCLLGSSNSHASASQVAGITGMCHHVWLIFVFLVETGFHHVAQAGLELLVSSSSPALASQSTEITGMSQCAWPL

SEQ ID NO: 3739 - protein, 16 aa, Homo sapiens
  Payload ID: 845;
  Gene Symbol:;
  Gene Name: AL445183.1;
  ENSP ID: ENSP00000485528
LGKPSATSTFSTHQLQ

SEQ ID NO: 3740 - protein, 835 aa, Homo sapiens
  Payload ID: 846;
  Gene Symbol:;
  Gene Name: AL513412.1;
  ENSP ID: ENSP00000442382
MKHYGLPWKRTEEAAADTALTIMEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKWAHVMCAVAVPEVRFTNVPERTQIDVGRIPLQRLKLGRLGI

SEQ ID NO: 3741 - protein, 140 aa, Homo sapiens
  Payload ID: 847;
  Gene Symbol:;
  Gene Name: AL513523.1;
  ENSP ID: ENSP00000471409
MALWETGGGDCGRGQGAEDFHYGLILQSLWLQSDPKYHWEQQCEGLEAPGGGKGLGAAWQLLKLSQRRKLLLPPGELGDAARVFPLQSPQPLLTFESPRRRGQSSRGWDGECRASVTVRAHCRGPFSFPLGRLRFRVFLF

SEQ ID NO: 3742 - protein, 140 aa, Homo sapiens; identical to SEQ ID NO: 3741
  Payload ID: 848;
  Gene Symbol:;
  Gene Name: AL513523.2;
  ENSP ID: ENSP00000485583

SEQ ID NO: 3743 - protein, 210 aa, Homo sapiens [sequence omitted]

SEQ ID NO: 3744 - protein, 124 aa, Homo sapiens
  Payload ID: 850;
  Gene Symbol:;
  Gene Name: AL590235.1;
  ENSP ID: ENSP00000485158
MTLNEHAAFKHLFNKAHLAPPLIHSTLRGHSTCFREHRVGGKVTDQQDPKAEEFFLVQNKMKSLPCLPLSTQTWQPSDFSIFSPPFPPFYSTKPPLSSWPVLNELLSTPPRRGGGRADGLLTSQ

SEQ ID NO: 3745 - protein, 50 aa, Homo sapiens
  Payload ID: 851;
  Gene Symbol:;
  Gene Name: AL591806.1;
  ENSP ID: ENSP00000485345
PLIYLFIYLFIYLFIETESHHVGQAGLKLLTSSDPPALASQSAGITGVSH

SEQ ID NO: 3746 - protein, 123 aa, Homo sapiens
  Payload ID: 852;
  Gene Symbol:;
  Gene Name: AL592183.1;
  ENSP ID: ENSP00000479921
MALLASNGCFIRCNEAGDIEAKSKTAGEEEMIKIRSCAERETKKKDDIPEEDKGNVKQCEINYVKKFQSFQEHKLKISKEDSKILKKAQKDGFLQETLLDSLGYEHRWKRWLLYWIKDMSRDG

SEQ ID NO: 3747 - protein, 44 aa, Homo sapiens
  Payload ID: 853;
  Gene Symbol:;
  Gene Name: AL596220.1;
  ENSP ID: ENSP00000485451
MCVYTYIYLSIYLSIYLSIILYTHILKKRGIFLVGCYNFILLIK

SEQ ID NO: 3748 - protein, 92 aa, Homo sapiens
  Payload ID: 854;
  Gene Symbol:;
  Gene Name: AL645728.1;
  ENSP ID: ENSP00000485620
GVISAHCNLHLPGSSDSPASASRVAGITGTHHHAWLIFVFLVETGFHHVGQDGLDLLTSDPPTSASHSAGITDVSHHAWPWILIFFFFEMES

SEQ ID NO: 3749 - protein, 23 aa, Homo sapiens
  Payload ID: 855;
  Gene Symbol:;
  Gene Name: AL645922.1;
  ENSP ID: ENSP00000485579
PTLCCLSCFSSLWPRWEDHLRPG

SEQ ID NO: 3750 - protein, 137 aa, Homo sapiens
  Payload ID: 856;
  Gene Symbol:;
  Gene Name: AL662852.1;
  ENSP ID: ENSP00000481180
MEGALADMKFYFIQILEKLSEAMSVLPEDMRIMPDLCGLTLEHSVLEAGKFKIKVPANFITWCPIMAHSFTQQPLPASKPQDTDLHQHMGQHYLPNSVEKRTFHHWVMRVDSDSWLLNARHDWRPFIVLLEKSMKKL

SEQ ID NO: 3751 - protein, 137 aa, Homo sapiens; identical to SEQ ID NO: 3750
  Payload ID: 857;
  Gene Symbol:;
  Gene Name: AL929561.1;
  ENSP ID: ENSP00000479324

SEQ ID NO: 3752 - protein, 155 aa, Homo sapiens
  Payload ID: 858;
  Gene Symbol: AARD;
  Gene Name: alanine and arginine rich domain containing prt;
  Uniprot ID:  Q4LEZ3;
  ENSP ID: ENSP00000367528
MGPGDFRRCRERISQGLQGLPGRAELWFPPRPACDFFGDGRSTDIQEEALAASPLLEDLRRRLTRAFQWAVQRAISRRVQEAAAAAAAREEQSWTGVEATLARLRAELVEMHFQNHQLARTLLDLNMKVQQLKKEYELEITSDSQSPKDDAANPE

SEQ ID NO: 3753 - protein, 392 aa, Homo sapiens
  Payload ID: 859;
  Gene Symbol: AGXT;
  Gene Name: alanine-glyoxylate aminotransferase;
  Uniprot ID:  P21549;
  ENSP ID: ENSP00000302620
MASHKLLVTPPKALLKPLSIPNQLLLGPGPSNLPPRIMAAGGLQMIGSMSKDMYQIMDEIKEGIQYVFQTRNPLTLVISGSGHCALEAALVNVLEPGDSFLVGANGIWGQRAVDIGERIGARVHPMTKDPGGHYTLQEVEEGLAQHKPVLLFLTHGESSTGVLQPLDGFGELCHRYKCLLLVDSVASLGGTPLYMDRQGIDILYSGSQKALNAPPGTSLISFSDKAKKKMYSRKTKPFSFYLDIKWLANFWGCDDQPRMYHHTIPVISLYSLRESLALIAEQGLENSWRQHREAAAYLHGRLQALGLQLFVKDPALRLPTVTTVAVPAGYDWRDIVSYVIDHFDIEIMGGLGPSTGKVLRIGLLGCNATRENVDRVTEALRAALQHCPKKKL

SEQ ID NO: 3754 - protein, 514 aa, Homo sapiens
  Payload ID: 860;
  Gene Symbol: AGXT2;
  Gene Name: alanine--glyoxylate aminotransferase 2;
  Uniprot ID:  Q9BYV1;
  ENSP ID: ENSP00000231420
MTLIWRHLLRPLCLVTSAPRILEMHPFLSLGTSRTSVTKLSLHTKPRMPPCDFMPERYQSLGYNRVLEIHKEHLSPVVTAYFQKPLLLHQGHMEWLFDAEGSRYLDFFSGIVTVSVGHCHPKVNAVAQKQLGRLWHTSTVFFHPPMHEYAEKLAALLPEPLKVIFLVNSGSEANELAMLMARAHSNNIDIISFRGAYHGCSPYTLGLTNVGTYKMELPGGTGCQPTMCPDVFRGPWGGSHCRDSPVQTIRKCSCAPDCCQAKDQYIEQFKDTLSTSVAKSIAGFFAEPIQGVNGVVQYPKGFLKEAFELVRARGGVCIADEVQTGFGRLGSHFWGFQTHDVLPDIVTMAKGIGNGFPMAAVITTPEIAKSLAKCLQHFNTFGGNPMACAIGSAVLEVIKEENLQENSQEVGTYMLLKFAKLRDEFEIVGDVRGKGLMIGIEMVQDKISCRPLPREEVNQIHEDCKHMGLLVGRGSIFSQTFRIAPSMCITKPEVDFAVEVFRSALTQHMERRAK

SEQ ID NO: 3755 - protein, 439 aa, Homo sapiens
  Payload ID: 860;
  Gene Symbol: AGXT2;
  Gene Name: alanine--glyoxylate aminotransferase 2;
  Uniprot ID:  Q9BYV1;
  ENSP ID: ENSP00000422799
MTLIWRHLLRPLCLVTSAPRILEMHPFLSLGTSRTSVTKLSLHTKPRMPPCDFMPERYQSLGYNRVLEIHKEHLSPVVTAYFQKPLLLHQGHMEWLFDAEGSRYLDFFSGIVTVSVGHCHPKVNAVAQKQLGRLWHTSTVFFHPPMHEYAEKLAALLPEPLKVIFLVNSGSEANELAMLMARAHSNNIDIISFRGAYHGCSPYTLGLTNVGTYKMELPGGTGCQPTMCPDVFRGPWGGSHCRDSPVQTIRKCSCAPDCCQAKDQYIEQFKDTLSTSVAKSIAGFFAEPIQGVNGVVQYPKGFLKEAFELVRARGGVCIADEVIKEENLQENSQEVGTYMLLKFAKLRDEFEIVGDVRGKGLMIGIEMVQDKISCRPLPREEVNQIHEDCKHMGLLVGRGSIFSQTFRIAPSMCITKPEVDFAVEVFRSALTQHMERRAK

SEQ ID NO: 3756 - protein, 439 aa, Homo sapiens; identical to SEQ ID NO: 3755
  Payload ID: 860;
  Gene Symbol: AGXT2;
  Gene Name: alanine--glyoxylate aminotransferase 2;
  Uniprot ID:  Q9BYV1;
  ENSP ID: ENSP00000479154

SEQ ID NO: 3757 - protein, 967 aa, Homo sapiens
  Payload ID: 861;
  Gene Symbol: ANPEP;
  Gene Name: alanyl (membrane) aminopeptidase;
  Uniprot ID:  P15144;
  ENSP ID: ENSP00000300060
MAKGFYISKSLGILGILLGVAAVCTIIALSVVYSQEKNKNANSSPVASTTPSASATTNPASATTLDQSKAWNRYRLPNTLKPDSYRVTLRPYLTPNDRGLYVFKGSSTVRFTCKEATDVIIIHSKKLNYTLSQGHRVVLRGVGGSQPPDIDKTELVEPTEYLVVHLKGSLVKDSQYEMDSEFEGELADDLAGFYRSEYMEGNVRKVVATTQMQAADARKSFPCFDEPAMKAEFNITLIHPKDLTALSNMLPKGPSTPLPEDPNWNVTEFHTTPKMSTYLLAFIVSEFDYVEKQASNGVLIRIWARPSAIAAGHGDYALNVTGPILNFFAGHYDTPYPLPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKNYLKKQVTPLFIHFRNNTNNWREIPENLMDQYSEVNAISTACSNGVPECEEMVSGLFKQWMENPNNNPIHPNLRSTVYCNAIAQGGEEEWDFAWEQFRNATLVNEADKLRAALACSKELWILNRYLSYTLNPDLIRKQDATSTIISITNNVIGQGLVWDFVQSNWKKLFNDYGGGSFSFSNLIQAVTRRFSTEYELQQLEQFKKDNEETGFGSGTRALEQALEKTKANIKWVKENKEVVLQWFTENSK

SEQ ID NO: 3758 - protein, 103 aa, Homo sapiens
  Payload ID: 861;
  Gene Symbol: ANPEP;
  Gene Name: alanyl (membrane) aminopeptidase;
  ENSP ID: ENSP00000452934
MAKGFYISKSLGILGILLGVAAVCTIIALSVVYSQEKNKNANSSPVASTTPSASATTNPASATTLDQSKAWNRYRLPNTLKPDSYRVTLRPYLTPNDRGLYVF

SEQ ID NO: 3759 - protein, 65 aa, Homo sapiens
  Payload ID: 861;
  Gene Symbol: ANPEP;
  Gene Name: alanyl (membrane) aminopeptidase;
  ENSP ID: ENSP00000453405
TLIHPKDLTALSNMLPKGPSTPLPEDPNWNVTEFHTTPKMSTYLLAFIVSEFDYVEKQASNGVLV

SEQ ID NO: 3760 - protein, 61 aa, Homo sapiens
  Payload ID: 861;
  Gene Symbol: ANPEP;
  Gene Name: alanyl (membrane) aminopeptidase;
  ENSP ID: ENSP00000453413
MAKGFYISKSLGILGILLGVAAVCTIIALSVVYSQEKNKNANSSPVASTTPSASATTNPAS

SEQ ID NO: 3761 - protein, 122 aa, Homo sapiens
  Payload ID: 861;
  Gene Symbol: ANPEP;
  Gene Name: alanyl (membrane) aminopeptidase;
  ENSP ID: ENSP00000453545
NDLWLNEGFASYVEYLGADYAEPTWNLKDLMVLNDVYRVMAVDALASSHPLSTPASEINTPAQISELFDAISYSKVQPAPRGARGRRAPQSSGCSPASCPRTYSSRAWRPTSTPLPTRTPST

SEQ ID NO: 3762 - protein, 968 aa, Homo sapiens
  Payload ID: 862;
  Gene Symbol: AARS;
  Gene Name: alanyl-tRNA synthetase;
  Uniprot ID:  P49588;
  ENSP ID: ENSP00000261772
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 3763 - protein, 280 aa, Homo sapiens
  Payload ID: 862;
  Gene Symbol: AARS;
  Gene Name: alanyl-tRNA synthetase;
  ENSP ID: ENSP00000455360
  MOD_RES (1)..(1): Any amino acid
XDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEPCSRDPMDPVLGPWTFPAAPSAASRRALPKH

SEQ ID NO: 3764 - protein, 985 aa, Homo sapiens
  Payload ID: 863;
  Gene Symbol: AARS2;
  Gene Name: alanyl-tRNA synthetase 2, mitochondrial;
  Uniprot ID:  Q5JTZ9;
  ENSP ID: ENSP00000244571
MAASVAAAARRLRRAIRRSPAWRGLSHRPLSSEPPAAKASAVRAAFLNFFRDRHGHRLVPSASVRPRGDPSLLFVNAGMNQFKPIFLGTVDPRSEMAGFRRVANSQKCVRAGGHHNDLEDVGRDLSHHTFFEMLGNWAFGGEYFKEEACNMAWELLTQVYGIPEERLWISYFDGDPKAGLDPDLETRDIWLSLGVPASRVLSFGPQENFWEMGDTGPCGPCTEIHYDLAGGVGAPQLVELWNLVFMQHNREADGSLQPLPQRHVDTGMGLERLVAVLQGKHSTYDTDLFSPLLNAIQQGCRAPPYLGRVGVADEGRTDTAYRVVADHIRTLSVCISDGIFPGMSGPPLVLRRILRRAVRFSMEILKAPPGFLGSLVPVVVETLGDAYPELQRNSAQIANLVSEDEAAFLASLERGRRIIDRTLRTLGPSDMFPAEVAWSLSLCGDLGLPLDMVELMLEEKGVQLDSAGLERLAQEEAQHRARQAEPVQKQGLWLDVHALGELQRQGVPPTDDSPKYNYSLRPSGSYEFGTCEAQVLQLYTEDGTAVASVGKGQRCGLLLDRTNFYAEQGGQASDRGYLVRAGQEDVLFPVARAQVCGGFILHEAVAPECLRLGDQVQLHVDEAWRLGCMAKHTATHLLNWALRQTLGPGTEQQGSHLNPEQLRLDVTTQTPLTPEQLRAVENTVQEAVGQDEAVYMEEVPLALTAQVPGLRSLDEVYPDPVRVVSVGVPVAHALDPASQAALQTSVELCCGTHLLRTGAVGDLVIIGDRQLSKGTTRLLAVTGEQAQQARELGQSLAQEVKAATERLSLGSRDVAEALRLSKDIGRLIEAVETAVMPQWQRRELLATVKMLQRRANTAIRKLQMGQAAKKTQELLERHSKGPLIVDTVSAESLSVLVKVVRQLCEQAPSTSVLLLSPQPMGKVLCACQVAQGAMPTFTAEAWALAVCSHMGGKAWGSRVVAQGTGSTTDLEAALSIAQTYALSQL

SEQ ID NO: 3765 - protein, 84 aa, Homo sapiens
  Payload ID: 864;
  Gene Symbol: AARSD1;
  Gene Name: alanyl-tRNA synthetase domain containing 1;
  ENSP ID: ENSP00000387415
MQQHSGQHLITAVADHLFKLKTTSWELGRFRSAIELDTPSMTAEQVAAIEQSVNEKIRDRLPVNVRELSLDDPEVEQVRWPGFA

SEQ ID NO: 3766 - protein, 140 aa, Homo sapiens
  Payload ID: 864;
  Gene Symbol: AARSD1;
  Gene Name: alanyl-tRNA synthetase domain containing 1;
  ENSP ID: ENSP00000400735
MQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNR

SEQ ID NO: 3767 - protein, 412 aa, Homo sapiens
  Payload ID: 864;
  Gene Symbol: AARSD1;
  Gene Name: alanyl-tRNA synthetase domain containing 1;
  Uniprot ID:  Q9BTE6;
  ENSP ID: ENSP00000400870
MAFWCQRDSYAREFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 3768 - protein, 98 aa, Homo sapiens
  Payload ID: 864;
  Gene Symbol: AARSD1;
  Gene Name: alanyl-tRNA synthetase domain containing 1;
  ENSP ID: ENSP00000404894
MAFWCQRDSYAREFTTTVVSCCPAELQTEGSNGKKEVLSGFQVVLEDTVLFPEGGGQMVSCSVARLERSGVISAYCNLRLPGSSNSPASVSRVARTTA

SEQ ID NO: 3769 - protein, 79 aa, Homo sapiens
  Payload ID: 864;
  Gene Symbol: AARSD1;
  Gene Name: alanyl-tRNA synthetase domain containing 1;
  ENSP ID: ENSP00000467696
  MOD_RES (1)..(1): Any amino acid
XSYAREFTTTVVSCCPAELQTEGSNGKKEVLSGFQVVLEDTVLFPEGGGQAGAQRRDLGLLQSPSARFKQFPCLSLPSS

SEQ ID NO: 3770 - protein, 94 aa, Homo sapiens
  Payload ID: 864;
  Gene Symbol: AARSD1;
  Gene Name: alanyl-tRNA synthetase domain containing 1;
  ENSP ID: ENSP00000467714
  MOD_RES (1)..(1): Any amino acid
XGKKNRTNLIFLSGNRVLKWMERSHGTEKALTALLKCGAEDHVEAVKKLQNSTKILQKNNLNLLRDLAVHIAHSLRNSPDWGGVVILHRRPSCS

SEQ ID NO: 3771 - protein, 609 aa, Homo sapiens [sequence omitted]

SEQ ID NO: 3772 - protein, 494 aa, Homo sapiens
  Payload ID: 865;
  Gene Symbol: ALB;
  Gene Name: albumin;
  ENSP ID: ENSP00000384695
MKWVTFISLLFLFSSAYSRGVFRRDAHKSEVAHRFKDLGEENFKALYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 3773 - protein, 197 aa, Homo sapiens
  Payload ID: 865;
  Gene Symbol: ALB;
  Gene Name: albumin;
  ENSP ID: ENSP00000392541
GFEWGGQRRASHNSTFSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQA

SEQ ID NO: 3774 - protein, 417 aa, Homo sapiens
  Payload ID: 865;
  Gene Symbol: ALB;
  Gene Name: albumin;
  ENSP ID: ENSP00000401820
MKWVTFISLLFLFSSAYSRGVFRRDAHKSEVAHRFKDLGEENFKALAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 3775 - protein, 459 aa, Homo sapiens
  Payload ID: 865;
  Gene Symbol: ALB;
  Gene Name: albumin;
  ENSP ID: ENSP00000421027
MSQLKIVTNHLYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 3776 - protein, 604 aa, Homo sapiens
  Payload ID: 865;
  Gene Symbol: ALB;
  Gene Name: albumin;
  ENSP ID: ENSP00000422784
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEPTMRIRERK

SEQ ID NO: 3777 - protein, 105 aa, Homo sapiens
  Payload ID: 865;
  Gene Symbol: ALB;
  Gene Name: albumin;
  ENSP ID: ENSP00000423727
MKWVTFISLLFLFSSAYSRGVFRRDAHTYMKLPEDILTFMPRNSFSLLKGIKLLLQNVAKLLIKLPACCQSSMNFGMKGRLRLPNRDSSVPVSKNLEKELSKHGQ

SEQ ID NO: 3778 - protein, 454 aa, Homo sapiens
  Payload ID: 865;
  Gene Symbol: ALB;
  Gene Name: albumin;
  ENSP ID: ENSP00000426179
  MOD_RES (1)..(1): Any amino acid
XFSKFRYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 3779 - protein, 396 aa, Homo sapiens
  Payload ID: 865;
  Gene Symbol: ALB;
  Gene Name: albumin;
  ENSP ID: ENSP00000480485
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 3780 - protein, 396 aa, Homo sapiens
  Payload ID: 865;
  Gene Symbol: ALB;
  Gene Name: albumin;
  Uniprot ID:  P02768;
  ENSP ID: ENSP00000483421
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 3781 - protein, 375 aa, Homo sapiens
  Payload ID: 866;
  Gene Symbol: ADH1A;
  Gene Name: alcohol dehydrogenase 1A (class I), alpha polypeptide;
  Uniprot ID:  P07327;
  ENSP ID: ENSP00000209668
MSTAGKVIKCKAAVLWELKKPFSIEEVEVAPPKAHEVRIKMVAVGICGTDDHVVSGTMVTPLPVILGHEAAGIVESVGEGVTTVKPGDKVIPLAIPQCGKCRICKNPESNYCLKNDVSNPQGTLQDGTSRFTCRRKPIHHFLGISTFSQYTVVDENAVAKIDAASPLEKVCLIGCGFSTGYGSAVNVAKVTPGSTCAVFGLGGVGLSAIMGCKAAGAARIIAVDINKDKFAKAKELGATECINPQDYKKPIQEVLKEMTDGGVDFSFEVIGRLDTMMASLLCCHEACGTSVIVGVPPDSQNLSMNPMLLLTGRTWKGAILGGFKSKECVPKLVADFMAKKFSLDALITHVLPFEKINEGFDLLHSGKSIRTILMF

SEQ ID NO: 3782 - protein, 375 aa, Homo sapiens
  Payload ID: 867;
  Gene Symbol: ADH1B;
  Gene Name: alcohol dehydrogenase 1B (class I), beta polypeptide;
  Uniprot ID:  P00325;
  ENSP ID: ENSP00000306606
MSTAGKVIKCKAAVLWEVKKPFSIEDVEVAPPKAYEVRIKMVAVGICHTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 3783 - protein, 335 aa, Homo sapiens
  Payload ID: 867;
  Gene Symbol: ADH1B;
  Gene Name: alcohol dehydrogenase 1B (class I), beta polypeptide;
  ENSP ID: ENSP00000425998
MVAVGICHTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 3784 - protein, 335 aa, Homo sapiens; identical to SEQ ID NO: 3783
  Payload ID: 867;
  Gene Symbol: ADH1B;
  Gene Name: alcohol dehydrogenase 1B (class I), beta polypeptide;
  ENSP ID: ENSP00000486614

SEQ ID NO: 3785 - protein, 375 aa, Homo sapiens
  Payload ID: 868;
  Gene Symbol: ADH1C;
  Gene Name: alcohol dehydrogenase 1C (class I), gamma polypeptide;
  Uniprot ID:  P00326;
  ENSP ID: ENSP00000426083
MSTAGKVIKCKAAVLWELKKPFSIEEVEVAPPKAHEVRIKMVAAGICRSDEHVVSGNLVTPLPVILGHEAAGIVESVGEGVTTVKPGDKVIPLFTPQCGKCRICKNPESNYCLKNDLGNPRGTLQDGTRRFTCSGKPIHHFVGVSTFSQYTVVDENAVAKIDAASPLEKVCLIGCGFSTGYGSAVKVAKVTPGSTCAVFGLGGVGLSVVMGCKAAGAARIIAVDINKDKFAKAKELGATECINPQDYKKPIQEVLKEMTDGGVDFSFEVIGRLDTMMASLLCCHEACGTSVIVGVPPDSQNLSINPMLLLTGRTWKGAIFGGFKSKESVPKLVADFMAKKFSLDALITNILPFEKINEGFDLLRSGKSIRTVLTF

SEQ ID NO: 3786 - protein, 192 aa, Homo sapiens
  Payload ID: 868;
  Gene Symbol: ADH1C;
  Gene Name: alcohol dehydrogenase 1C (class I), gamma polypeptide;
  ENSP ID: ENSP00000478439
MVAAGICRSDEHVVSGNLVTPLPVILGHEAAGIVESVGEGVTTVKPGDKVIPLFTPQCGKCRICKNPESNYCLKNDLGNPRGTLQDGTRRFTCSGKPIHHFVGVSTFSQYTVVDENAVAKIDAASPLEKVCLIGCGFSTGYGSAVKVAKVTPGSTCAVFGLGGVGLSVVMGCKAAGAARIIAVDINKDKFAK

SEQ ID NO: 3787 - protein, 170 aa, Homo sapiens
  Payload ID: 868;
  Gene Symbol: ADH1C;
  Gene Name: alcohol dehydrogenase 1C (class I), gamma polypeptide;
  ENSP ID: ENSP00000478545
MSTAGKMVAAGICRSDEHVVSGNLVTPLPVILGHEAAGIVESVGEGVTTVKPGDKVIPLFTPQCGKCRICKNPESNYCLKNDLGNPRGTLQDGTRRFTCSGKPIHHFVGVSTFSQYTVVDENAVAKIDAASPLEKVCLIGCGFSTGYGSAVKVAKVTPGSTCAVFGLGGV

SEQ ID NO: 3788 - protein, 380 aa, Homo sapiens
  Payload ID: 869;
  Gene Symbol: ADH4;
  Gene Name: alcohol dehydrogenase 4 (class II), pi polypeptide;
  Uniprot ID:  P08319;
  ENSP ID: ENSP00000265512
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLAKIDDDANLERVCLLGCGFSTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTIFPEELIIGRTINGTFFGGWKSVDSIPKLVTDYKNKKFNLDALVTHTLPFDKISEAFDLMNQGKSVRTILIF

SEQ ID NO: 3789 - protein, 257 aa, Homo sapiens
  Payload ID: 869;
  Gene Symbol: ADH4;
  Gene Name: alcohol dehydrogenase 4 (class II), pi polypeptide;
  ENSP ID: ENSP00000423571
MLVRGPHFELQRCKTHLFSSNYLTQVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLAKIDDDANLERVCLLGCGFSTGYGAAINNAKVTPGSTCAVFGLGGVGLSAVMGCKAAGASRIIGIDINSEKFVKA

SEQ ID NO: 3790 - protein, 115 aa, Homo sapiens
  Payload ID: 869;
  Gene Symbol: ADH4;
  Gene Name: alcohol dehydrogenase 4 (class II), pi polypeptide;
  ENSP ID: ENSP00000424583
NLERVCLLGCGFSTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMVGKV

SEQ ID NO: 3791 - protein, 399 aa, Homo sapiens
  Payload ID: 869;
  Gene Symbol: ADH4;
  Gene Name: alcohol dehydrogenase 4 (class II), pi polypeptide;
  Uniprot ID:  P08319;
  ENSP ID: ENSP00000424630
MLVRGPHFELQRCKTHLFSSNYLTQVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLAKIDDDANLERVCLLGCGFSTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTIFPEELIIGRTINGTFFGGWKSVDSIPKLVTDYKNKKFNLDALVTHTLPFDKISEAFDLMNQGKSVRTILIF

SEQ ID NO: 3792 - protein, 399 aa, Homo sapiens; identical to SEQ ID NO: 3791
  Payload ID: 869;
  Gene Symbol: ADH4;
  Gene Name: alcohol dehydrogenase 4 (class II), pi polypeptide;
  Uniprot ID:  P08319;
  ENSP ID: ENSP00000425416

SEQ ID NO: 3793 - protein, 36 aa, Homo sapiens
  Payload ID: 869;
  Gene Symbol: ADH4;
  Gene Name: alcohol dehydrogenase 4 (class II), pi polypeptide;
  ENSP ID: ENSP00000426667
MLVRGPHFELQRCKTHLFSSNYLTQREKLETLYQGY

SEQ ID NO: 3794 - protein, 36 aa, Homo sapiens; identical to SEQ ID NO: 3793
  Payload ID: 869;
  Gene Symbol: ADH4;
  Gene Name: alcohol dehydrogenase 4 (class II), pi polypeptide;
  ENSP ID: ENSP00000427261

SEQ ID NO: 3795 - protein, 206 aa, Homo sapiens
  Payload ID: 869;
  Gene Symbol: ADH4;
  Gene Name: alcohol dehydrogenase 4 (class II), pi polypeptide;
  ENSP ID: ENSP00000427525
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKIRFTCKGKPVYHFFGTSTFSQYTVVSDINLAKIDDDANLERVCLLGCGFSTGYGAAINNAKVTPGSTCAVFGLGGVGLSAVMGCKAAGASR

SEQ ID NO: 3796 - protein, 391 aa, Homo sapiens
  Payload ID: 869;
  Gene Symbol: ADH4;
  Gene Name: alcohol dehydrogenase 4 (class II), pi polypeptide;
  ENSP ID: ENSP00000486450
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLAKIDDDANLERVCLLGCGFSTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTIFPEELIIGRTINGTFFGGWKSVDSIPKLVTDYKNKKFNLDALVTHTLPFDKISEAFDLMNQGKSVRTILIFRCQEQFRILSD

SEQ ID NO: 3797 - protein, 374 aa, Homo sapiens
  Payload ID: 870;
  Gene Symbol: ADH5;
  Gene Name: alcohol dehydrogenase 5 (class III), chi polypeptide;
  Uniprot ID:  P11766;
  ENSP ID: ENSP00000296412
MANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKTILHYMGTSTFSEYTVVADISVAKIDPLAPLDKVCLLGCGISTGYGAAVNTAKLEPGSVCAVFGLGGVGLAVIMGCKVAGASRIIGVDINKDKFARAKEFGATECINPQDFSKPIQEVLIEMTDGGVDYSFECIGNVKVMRAALEACHKGWGVSVVVGVAASGEEIATRPFQLVTGRTWKGTAFGGWKSVESVPKLVSEYMSKKIKVDEFVTHNLSFDEINKAFELMHSGKSIRTVVKI

SEQ ID NO: 3798 - protein, 115 aa, Homo sapiens
  Payload ID: 870;
  Gene Symbol: ADH5;
  Gene Name: alcohol dehydrogenase 5 (class III), chi polypeptide;
  ENSP ID: ENSP00000421556
MANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPKTNLCQKIR

SEQ ID NO: 3799 - protein, 95 aa, Homo sapiens
  Payload ID: 870;
  Gene Symbol: ADH5;
  Gene Name: alcohol dehydrogenase 5 (class III), chi polypeptide;
  ENSP ID: ENSP00000422119
MANEVIKCKAAVAWEAGKPLSIEEIEVAPPKAHEVRIKIIATAVCHTDAYTLSGADPEGCFPVILGHEGAGIVESVGEGVTKLKAVWRMQILSKS

SEQ ID NO: 3800 - protein, 56 aa, Homo sapiens
  Payload ID: 870;
  Gene Symbol: ADH5;
  Gene Name: alcohol dehydrogenase 5 (class III), chi polypeptide;
  ENSP ID: ENSP00000424650
MANEVIKCKAAVAWEAGKPLSIEEIEVAPPKAHEVRIKVTLSSHFTSHSVENANFV

SEQ ID NO: 3801 - protein, 15 aa, Homo sapiens
  Payload ID: 870;
  Gene Symbol: ADH5;
  Gene Name: alcohol dehydrogenase 5 (class III), chi polypeptide;
  ENSP ID: ENSP00000427026
MANEFCTKPVVFRTA

SEQ ID NO: 3802 - protein, 262 aa, Homo sapiens
  Payload ID: 870;
  Gene Symbol: ADH5;
  Gene Name: alcohol dehydrogenase 5 (class III), chi polypeptide;
  ENSP ID: ENSP00000427049
VIKCKAAVAWEAGKPLSIEEIEVAPPKAHEVRIKIIATAVCHTDAYTLSGADPEGCFPVILGHEGAGIVESVGDTVIPLYIPQCGECKFCLNPKTNLCQKIRVTQGKGLMPDGTSRFTCKGKTILHYMGTSTFSEYTVVADISVAKIDPLAPLDKVCLLGCGISTGYGAAVNTAKLEPGSVCAVFGLGGVGLAVIMGCKVAGASRIIGVDINKDKFARAKEFGATECINPQDFSKPIQEVLIEMTDGGVDYSFECIGNVKVM

SEQ ID NO: 3803 - protein, 56 aa, Homo sapiens; identical to SEQ ID NO: 3800
  Payload ID: 870;
  Gene Symbol: ADH5;
  Gene Name: alcohol dehydrogenase 5 (class III), chi polypeptide;
  ENSP ID: ENSP00000487496

SEQ ID NO: 3804 - protein, 368 aa, Homo sapiens
  Payload ID: 871;
  Gene Symbol: ADH6;
  Gene Name: alcohol dehydrogenase 6 (class V);
  Uniprot ID:  P28332;
  ENSP ID: ENSP00000237653
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKSIYHFGNTSTFCEYTVIKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAAALASCNESYGVCVVVGVLPASVQLKISGQLFFSGRSLKGSVFGGWKSRQHIPKLVADYMAEKLNLDPLITHTLNLDKINEAVELMKTGKW

SEQ ID NO: 3805 - protein, 295 aa, Homo sapiens
  Payload ID: 871;
  Gene Symbol: ADH6;
  Gene Name: alcohol dehydrogenase 6 (class V);
  ENSP ID: ENSP00000378358
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKSIYHFGNTSTFCEYTVIKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAGRADSTSLNWLLIIWQRS

SEQ ID NO: 3806 - protein, 375 aa, Homo sapiens
  Payload ID: 871;
  Gene Symbol: ADH6;
  Gene Name: alcohol dehydrogenase 6 (class V);
  ENSP ID: ENSP00000378359
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKSIYHFGNTSTFCEYTVIKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAAALASCNESYGVCVVVGVLPASVQLKISGQLFFSGRSLKGSVFGGWKSRQHIPKLVADYMAEKLNLDPLITHTLNLDKINEAVELMKTGKCIRCILLL

SEQ ID NO: 3807 - protein, 68 aa, Homo sapiens
  Payload ID: 871;
  Gene Symbol: ADH6;
  Gene Name: alcohol dehydrogenase 6 (class V);
  ENSP ID: ENSP00000422124
EKFKKAQELGATECLNPQDLKKPIQEVLFDMTDAGIDFCFEAIGNLDVLAGRADSTSLNWLLIIWQRS

SEQ ID NO: 3808 - protein, 58 aa, Homo sapiens
  Payload ID: 871;
  Gene Symbol: ADH6;
  Gene Name: alcohol dehydrogenase 6 (class V);
  ENSP ID: ENSP00000425275
MSTTGQVIRCKAAILWKPGAPFSIEEVEVAPPKAKEVRIKVTKLSHSFCHSVENVPLA

SEQ ID NO: 3809 - protein, 257 aa, Homo sapiens
  Payload ID: 871;
  Gene Symbol: ADH6;
  Gene Name: alcohol dehydrogenase 6 (class V);
  ENSP ID: ENSP00000426187
MSTTGQVIRCKAAILWKPGAPFSIEEVEVAPPKAKEVRIKVVATGLCGTEMKVLGSKHLDLLYPTILGHEGAGIVESIGEGVSTVKPVIKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAAALASCNESYGVCVVVGVLPASVQLKISGQLFFSGRSLKGSVFG

SEQ ID NO: 3810 - protein, 386 aa, Homo sapiens
  Payload ID: 872;
  Gene Symbol: ADH7;
  Gene Name: alcohol dehydrogenase 7 (class IV), mu or sigma polypeptide;
  Uniprot ID:  P40394;
  ENSP ID: ENSP00000209665
MFAEIQIQDKDRMGTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 3811 - protein, 374 aa, Homo sapiens
  Payload ID: 872;
  Gene Symbol: ADH7;
  Gene Name: alcohol dehydrogenase 7 (class IV), mu or sigma polypeptide;
  ENSP ID: ENSP00000414254
MGTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 3812 - protein, 394 aa, Homo sapiens
  Payload ID: 872;
  Gene Symbol: ADH7;
  Gene Name: alcohol dehydrogenase 7 (class IV), mu or sigma polypeptide;
  Uniprot ID:  P40394;
  ENSP ID: ENSP00000420269
MKCLVSRHTVRETLDMVFQRMSVEAGVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 3813 - protein, 107 aa, Homo sapiens
  Payload ID: 872;
  Gene Symbol: ADH7;
  Gene Name: alcohol dehydrogenase 7 (class IV), mu or sigma polypeptide;
  ENSP ID: ENSP00000420300
MVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAA

SEQ ID NO: 3814 - protein, 317 aa, Homo sapiens
  Payload ID: 872;
  Gene Symbol: ADH7;
  Gene Name: alcohol dehydrogenase 7 (class IV), mu or sigma polypeptide;
  ENSP ID: ENSP00000420613
MVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 3815 - protein, 38 aa, Homo sapiens
  Payload ID: 873;
  Gene Symbol: ADHFE1;
  Gene Name: alcohol dehydrogenase, iron containing, 1;
  ENSP ID: ENSP00000276576
MAAAARARVAYLLRQLQRAACQCPTHSHTYSQDGCFKY

SEQ ID NO: 3816 - protein, 126 aa, Homo sapiens
  Payload ID: 873;
  Gene Symbol: ADHFE1;
  Gene Name: alcohol dehydrogenase, iron containing, 1;
  ENSP ID: ENSP00000379864
MAAAARARVAYLLRQLQRAACQCPTHSHTYSQAPGLSPSGKTTDYAFEMAVSNIRYGAAVTKEVGMDLKNMGAKNVCLMTDKNLSKLPPVQVAMDSLVKNGIPFTVYDNVRVEPTDSSANYLRNRE

SEQ ID NO: 3817 - protein, 467 aa, Homo sapiens
  Payload ID: 873;
  Gene Symbol: ADHFE1;
  Gene Name: alcohol dehydrogenase, iron containing, 1;
  Uniprot ID:  Q8IWW8;
  ENSP ID: ENSP00000379865
MAAAARARVAYLLRQLQRAACQCPTHSHTYSQAPGLSPSGKTTDYAFEMAVSNIRYGAAVTKEVGMDLKNMGAKNVCLMTDKNLSKLPPVQVAMDSLVKNGIPFTVYDNVRVEPTDSSFMEAIEFAQKGAFDAYVAVGGGSTMDTCKAANLYASSPHSDFLDYVSAPIGKGKPVSVPLKPLIAVPTTSGTGSETTGVAIFDYEHLKVKIGITSRAIKPTLGLIDPLHTLHMPARVVANSGFDVLCHALESYTTLPYHLRSPCPSNPITRPAYQGSNPISDIWAIHALRIVAKYLKRAVRNPDDLEARSHMHLASAFAGIGFGNAGVHLCHGMSYPISGLVKMYKAKDYNVDHPLVPHGLSVVLTSPAVFTFTAQMFPERHLEMAEILGADTRTARIQDAGLVLADTLRKFLFDLDVDDGLAAVGYSKADIPALVKGTLPQERVTKLAPCPQSEEDLAALFEASMKLY

SEQ ID NO: 3818 - protein, 131 aa, Homo sapiens
  Payload ID: 873;
  Gene Symbol: ADHFE1;
  Gene Name: alcohol dehydrogenase, iron containing, 1;
  ENSP ID: ENSP00000387956
MAAAARARVAYLLRQLQRAACQCPTHSHTYSQAPGLSPSGKTTDYAFEMAVSNIRYGAAVTKEVGMDLKNMGAKNVCLMTDKNLSKLPPVQVAMDSLVKNGIPFTVYDNVRVEPTDSRHHFESHQTHTGTD

SEQ ID NO: 3819 - protein, 34 aa, Homo sapiens
  Payload ID: 873;
  Gene Symbol: ADHFE1;
  Gene Name: alcohol dehydrogenase, iron containing, 1;
  ENSP ID: ENSP00000392040
MAAAARARVAYLLRQLQRAAPWTFTFWENNRLCL

SEQ ID NO: 3820 - protein, 34 aa, Homo sapiens; identical to SEQ ID NO: 3819
  Payload ID: 873;
  Gene Symbol: ADHFE1;
  Gene Name: alcohol dehydrogenase, iron containing, 1;
  ENSP ID: ENSP00000392925

SEQ ID NO: 3821 - protein, 38 aa, Homo sapiens; identical to SEQ ID NO: 3815
  Payload ID: 873;
  Gene Symbol: ADHFE1;
  Gene Name: alcohol dehydrogenase, iron containing, 1;
  ENSP ID: ENSP00000406905

SEQ ID NO: 3822 - protein, 419 aa, Homo sapiens
  Payload ID: 873;
  Gene Symbol: ADHFE1;
  Gene Name: alcohol dehydrogenase, iron containing, 1;
  Uniprot ID:  Q8IWW8;
  ENSP ID: ENSP00000407115
MAVSNIRYGAAVTKEVGMDLKNMGAKNVCLMTDKNLSKLPPVQVAMDSLVKNGIPFTVYDNVRVEPTDSSFMEAIEFAQKGAFDAYVAVGGGSTMDTCKAANLYASSPHSDFLDYVSAPIGKGKPVSVPLKPLIAVPTTSGTGSETTGVAIFDYEHLKVKIGITSRAIKPTLGLIDPLHTLHMPARVVANSGFDVLCHALESYTTLPYHLRSPCPSNPITRPAYQGSNPISDIWAIHALRIVAKYLKRAVRNPDDLEARSHMHLASAFAGIGFGNAGVHLCHGMSYPISGLVKMYKAKDYNVDHPLVPHGLSVVLTSPAVFTFTAQMFPERHLEMAEILGADTRTARIQDAGLVLADTLRKFLFDLDVDDGLAAVGYSKADIPALVKGTLPQERVTKLAPCPQSEEDLAALFEASMKLY

SEQ ID NO: 3823 - protein, 35 aa, Homo sapiens
  Payload ID: 873;
  Gene Symbol: ADHFE1;
  Gene Name: alcohol dehydrogenase, iron containing, 1;
  ENSP ID: ENSP00000409714
MAAAARARVAYLLRQLQRAAWLFQILDMEQQLQRK

SEQ ID NO: 3824 - protein, 303 aa, Homo sapiens
  Payload ID: 873;
  Gene Symbol: ADHFE1;
  Gene Name: alcohol dehydrogenase, iron containing, 1;
  Uniprot ID:  Q8IWW8;
  ENSP ID: ENSP00000410883
MAAAARARVAYLLRQLQRAACQCPTHSHTYSQAPGLSPSGKTTDYAFEMAVSNIRYGAAVTKEVGMDLKNMGAKNVCLMTDKNLSKLPPVQVAMDSLVKNGIPFTVYDNVRVEPTDSSFMEAIEFAQKGAFDAYVAVGGGSTMDTCKAANLYASSPHSDFLDYVSAPIGKGKPVSVPLKPLIAVPTTSGTGSETTGVAIFDYEHLKVKIGITSRAIKPTLGLIDPLHTLHMPARVVANSGFDVLCHALESYTTLPYHLRSPCPSNPITRPAYQGSNPISDIWAIHALRIVAKYLKRAVNSTDK

SEQ ID NO: 3825 - protein, 35 aa, Homo sapiens; identical to SEQ ID NO: 3823
  Payload ID: 873;
  Gene Symbol: ADHFE1;
  Gene Name: alcohol dehydrogenase, iron containing, 1;
  ENSP ID: ENSP00000416450

SEQ ID NO: 3826 - protein, 88 aa, Homo sapiens
  Payload ID: 873;
  Gene Symbol: ADHFE1;
  Gene Name: alcohol dehydrogenase, iron containing, 1;
  ENSP ID: ENSP00000428055
MDLKNMGAKNVCLMTDKNLSKLPPVQVAMDSLVKNGIPFTVYDNVRVEPTDSSFMEAIEFAQKGAFDAYVAVGGGSTMDTCKAANLYA

SEQ ID NO: 3827 - protein, 501 aa, Homo sapiens
  Payload ID: 874;
  Gene Symbol: ALDH1A1;
  Gene Name: aldehyde dehydrogenase 1 family, member A1;
  Uniprot ID:  P00352;
  ENSP ID: ENSP00000297785
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 3828 - protein, 230 aa, Homo sapiens
  Payload ID: 874;
  Gene Symbol: ALDH1A1;
  Gene Name: aldehyde dehydrogenase 1 family, member A1;
  ENSP ID: ENSP00000366138
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGASVV

SEQ ID NO: 3829 - protein, 238 aa, Homo sapiens
  Payload ID: 874;
  Gene Symbol: ALDH1A1;
  Gene Name: aldehyde dehydrogenase 1 family, member A1;
  ENSP ID: ENSP00000388026
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMD

SEQ ID NO: 3830 - protein, 203 aa, Homo sapiens
  Payload ID: 874;
  Gene Symbol: ALDH1A1;
  Gene Name: aldehyde dehydrogenase 1 family, member A1;
  ENSP ID: ENSP00000401361
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTAL

SEQ ID NO: 3831 - protein, 518 aa, Homo sapiens
  Payload ID: 875;
  Gene Symbol: ALDH1A2;
  Gene Name: aldehyde dehydrogenase 1 family, member A2;
  Uniprot ID:  O94788;
  ENSP ID: ENSP00000249750
MTSSKIEMPGEVKADPAALMASLHLLPSPTPNLEIKYTKIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 3832 - protein, 480 aa, Homo sapiens
  Payload ID: 875;
  Gene Symbol: ALDH1A2;
  Gene Name: aldehyde dehydrogenase 1 family, member A2;
  Uniprot ID:  O94788;
  ENSP ID: ENSP00000309623
MTSSKIEMPGEVKADPAALMASLHLLPSPTPNLEIKYTKIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 3833 - protein, 40 aa, Homo sapiens
  Payload ID: 875;
  Gene Symbol: ALDH1A2;
  Gene Name: aldehyde dehydrogenase 1 family, member A2;
  ENSP ID: ENSP00000416754
MTSSKIEMPGEVKADPAALMASLHLLPSPTPNLEIKYTKV

SEQ ID NO: 3834 - protein, 497 aa, Homo sapiens
  Payload ID: 875;
  Gene Symbol: ALDH1A2;
  Gene Name: aldehyde dehydrogenase 1 family, member A2;
  Uniprot ID:  O94788;
  ENSP ID: ENSP00000438296
MKNQCETVWLKSPIKLKLIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 3835 - protein, 85 aa, Homo sapiens
  Payload ID: 875;
  Gene Symbol: ALDH1A2;
  Gene Name: aldehyde dehydrogenase 1 family, member A2;
  ENSP ID: ENSP00000452850
MDASERGRLLDKLADLVERDRAVLATMESLNGGKPFLQAFYVDLQGVIKTFRYYAGWADKIHGMTIPVDGDYFTFTRHEPIGVCG

SEQ ID NO: 3836 - protein, 25 aa, Homo sapiens
  Payload ID: 875;
  Gene Symbol: ALDH1A2;
  Gene Name: aldehyde dehydrogenase 1 family, member A2;
  ENSP ID: ENSP00000453292
MDASERGRLLDKLADLVERDRAVLA

SEQ ID NO: 3837 - protein, 422 aa, Homo sapiens
  Payload ID: 875;
  Gene Symbol: ALDH1A2;
  Gene Name: aldehyde dehydrogenase 1 family, member A2;
  Uniprot ID:  O94788;
  ENSP ID: ENSP00000453408
MDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 3838 - protein, 489 aa, Homo sapiens
  Payload ID: 875;
  Gene Symbol: ALDH1A2;
  Gene Name: aldehyde dehydrogenase 1 family, member A2;
  ENSP ID: ENSP00000453600
MKGRNWKTTKIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 3839 - protein, 24 aa, Homo sapiens
  Payload ID: 875;
  Gene Symbol: ALDH1A2;
  Gene Name: aldehyde dehydrogenase 1 family, member A2;
  ENSP ID: ENSP00000453734
  MOD_RES (1)..(1): Any amino acid
XGEFGLREYSEVKTVTVKIPQKNS

SEQ ID NO: 3840 - protein, 9 aa, Homo sapiens
  Payload ID: 875;
  Gene Symbol: ALDH1A2;
  Gene Name: aldehyde dehydrogenase 1 family, member A2;
  ENSP ID: ENSP00000454028
MDASERGRL

SEQ ID NO: 3841 - protein, 512 aa, Homo sapiens
  Payload ID: 876;
  Gene Symbol: ALDH1A3;
  Gene Name: aldehyde dehydrogenase 1 family, member A3;
  Uniprot ID:  P47895;
  ENSP ID: ENSP00000332256
MATANGAVENGQPDRKPPALPRPIRNLEVKFTKIFINNEWHESKSGKKFATCNPSTREQICEVEEGDKPDVDKAVEAAQVAFQRGSPWRRLDALSRGRLLHQLADLVERDRATLAALETMDTGKPFLHAFFIDLEGCIRTLRYFAGWADKIQGKTIPTDDNVVCFTRHEPIGVCGAITPWNFPLLMLVWKLAPALCCGNTMVLKPAEQTPLTALYLGSLIKEAGFPPGVVNIVPGFGPTVGAAISSHPQINKIAFTGSTEVGKLVKEAASRSNLKRVTLELGGKNPCIVCADADLDLAVECAHQGVFFNQGQCCTAASRVFVEEQVYSEFVRRSVEYAKKRPVGDPFDVKTEQGPQIDQKQFDKILELIESGKKEGAKLECGGSAMEDKGLFIKPTVFSEVTDNMRIAKEEIFGPVQPILKFKSIEEVIKRANSTDYGLTAAVFTKNLDKALKLASALESGTVWINCYNALYAQAPFGGFKMSGNGRELGEYALAEYTEVKTVTIKLGDKNP

SEQ ID NO: 3842 - protein, 405 aa, Homo sapiens
  Payload ID: 876;
  Gene Symbol: ALDH1A3;
  Gene Name: aldehyde dehydrogenase 1 family, member A3;
  ENSP ID: ENSP00000343294
MATANGAVENGQPDRKPPALPRPIRNLEVKFTKIFINNEWHESKSGKKFATCNPSTREQICEVEEGDKPDVDKAVEAAQVAFQRGSPWRRLDALSRGRLLHQLADLVERDRATLAAGFPPGVVNIVPGFGPTVGAAISSHPQINKIAFTGSTEVGKLVKEAASRSNLKRVTLELGGKNPCIVCADADLDLAVECAHQGVFFNQGQCCTAASRVFVEEQVYSEFVRRSVEYAKKRPVGDPFDVKTEQGPQIDQKQFDKILELIESGKKEGAKLECGGSAMEDKGLFIKPTVFSEVTDNMRIAKEEIFGPVQPILKFKSIEEVIKRANSTDYGLTAAVFTKNLDKALKLASALESGTVWINCYNALYAQAPFGGFKMSGNGRELGEYALAEYTEVKTVTIKLGDKNP

SEQ ID NO: 3843 - protein, 144 aa, Homo sapiens
  Payload ID: 876;
  Gene Symbol: ALDH1A3;
  Gene Name: aldehyde dehydrogenase 1 family, member A3;
  ENSP ID: ENSP00000452789
MSECEIFINNEWHESKSGKKFATCNPSTREQICEVEEGDKPDVDKAVEAAQVAFQRGSPWRRLDALSRGRLLHQLADLVERDRATLAALETMDTGKPFLHAFFIDLEGCIRTLRYFAGWADKIQGKTIPTDDNVVCFTRHEPIG

SEQ ID NO: 3844 - protein, 102 aa, Homo sapiens
  Payload ID: 876;
  Gene Symbol: ALDH1A3;
  Gene Name: aldehyde dehydrogenase 1 family, member A3;
  ENSP ID: ENSP00000453328
MATANGAVENGQPDRKPPALPRPIRNLEVKFTKVRRAPLPPDGRGPLRWAARLGAAGAREQRAGGPPGAAETRASLPGRGSPETAPFAGRLGRDRRRRGSAL

SEQ ID NO: 3845 - protein, 141 aa, Homo sapiens
  Payload ID: 876;
  Gene Symbol: ALDH1A3;
  Gene Name: aldehyde dehydrogenase 1 family, member A3;
  ENSP ID: ENSP00000454107
MATANGAVENGQPDRKPPALPRPIRNLEVKFTKIFINNEWHESKSGKKFATCNPSTREQICEVEEGDKPDVDKAVEAAQVAFQRGSPWRRLDALSRGRLLHQLADLVERDRATLAMTTSCASPGMSPLVSVGPSLHGTSPC

SEQ ID NO: 3846 - protein, 517 aa, Homo sapiens [sequence omitted]

SEQ ID NO: 3847 - protein, 130 aa, Homo sapiens
  Payload ID: 877;
  Gene Symbol: ALDH1B1;
  Gene Name: aldehyde dehydrogenase 1 family, member B1;
  ENSP ID: ENSP00000489053
MLRFLAPRLLSLQGRTARYSSAAALPSPILNPDIPYNQLFINNEWQDAVSKKTFPTVNPTTGEVIGHVAEGDRADVDRAVKAAREAFRLGSPWRRMDASERGRLLNRLADLVERDRVYLASLETLDNGKP

SEQ ID NO: 3848 - protein, 912 aa, Homo sapiens
  Payload ID: 878;
  Gene Symbol: ALDH1L1;
  Gene Name: aldehyde dehydrogenase 1 family, member L1;
  Uniprot ID:  O75891;
  ENSP ID: ENSP00000273450
MAGPSNPPATMKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 3849 - protein, 505 aa, Homo sapiens
  Payload ID: 878;
  Gene Symbol: ALDH1L1;
  Gene Name: aldehyde dehydrogenase 1 family, member L1;
  Uniprot ID:  O75891;
  ENSP ID: ENSP00000377081
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRAPPSPSTRPDPTAT

SEQ ID NO: 3850 - protein, 902 aa, Homo sapiens
  Payload ID: 878;
  Gene Symbol: ALDH1L1;
  Gene Name: aldehyde dehydrogenase 1 family, member L1;
  Uniprot ID:  O75891;
  ENSP ID: ENSP00000377083
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 3851 - protein, 801 aa, Homo sapiens
  Payload ID: 878;
  Gene Symbol: ALDH1L1;
  Gene Name: aldehyde dehydrogenase 1 family, member L1;
  Uniprot ID:  O75891;
  ENSP ID: ENSP00000395881
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 3852 - protein, 505 aa, Homo sapiens; identical to SEQ ID NO: 3849
  Payload ID: 878;
  Gene Symbol: ALDH1L1;
  Gene Name: aldehyde dehydrogenase 1 family, member L1;
  Uniprot ID:  O75891;
  ENSP ID: ENSP00000414126

SEQ ID NO: 3853 - protein, 177 aa, Homo sapiens
  Payload ID: 878;
  Gene Symbol: ALDH1L1;
  Gene Name: aldehyde dehydrogenase 1 family, member L1;
  ENSP ID: ENSP00000418711
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMV

SEQ ID NO: 3854 - protein, 81 aa, Homo sapiens
  Payload ID: 878;
  Gene Symbol: ALDH1L1;
  Gene Name: aldehyde dehydrogenase 1 family, member L1;
  ENSP ID: ENSP00000418905
MKIAVIGQSLFGQEVYCHLRKEGHEVVGVFTVPDKDGKADPLGPSFTEIRKGGFPSSGRMMVWTPETCCCRRSVRCSRTTP

SEQ ID NO: 3855 - protein, 47 aa, Homo sapiens
  Payload ID: 878;
  Gene Symbol: ALDH1L1;
  Gene Name: aldehyde dehydrogenase 1 family, member L1;
  ENSP ID: ENSP00000419448
MKIAVIGQSLFGQEVYCHLRKEGHEVVGVFTVPDKDGKADPLDTRTE

SEQ ID NO: 3856 - protein, 168 aa, Homo sapiens
  Payload ID: 878;
  Gene Symbol: ALDH1L1;
  Gene Name: aldehyde dehydrogenase 1 family, member L1;
  ENSP ID: ENSP00000419826
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFL

SEQ ID NO: 3857 - protein, 157 aa, Homo sapiens
  Payload ID: 878;
  Gene Symbol: ALDH1L1;
  Gene Name: aldehyde dehydrogenase 1 family, member L1;
  ENSP ID: ENSP00000419955
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPD

SEQ ID NO: 3858 - protein, 902 aa, Homo sapiens; identical to SEQ ID NO: 3850
  Payload ID: 878;
  Gene Symbol: ALDH1L1;
  Gene Name: aldehyde dehydrogenase 1 family, member L1;
  Uniprot ID:  O75891;
  ENSP ID: ENSP00000420293

SEQ ID NO: 3859 - protein, 100 aa, Homo sapiens
  Payload ID: 878;
  Gene Symbol: ALDH1L1;
  Gene Name: aldehyde dehydrogenase 1 family, member L1;
  ENSP ID: ENSP00000426594
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRH

SEQ ID NO: 3860 - protein, 47 aa, Homo sapiens; identical to SEQ ID NO: 3855
  Payload ID: 878;
  Gene Symbol: ALDH1L1;
  Gene Name: aldehyde dehydrogenase 1 family, member L1;
  ENSP ID: ENSP00000426713

SEQ ID NO: 3861 - protein, 923 aa, Homo sapiens
  Payload ID: 879;
  Gene Symbol: ALDH1L2;
  Gene Name: aldehyde dehydrogenase 1 family, member L2;
  Uniprot ID:  Q3SY69;
  ENSP ID: ENSP00000258494
MLRRGSQALRRFSTGRVYFKNKLKLALIGQSLFGQEVYSHLRKEGHRVVGVFTVPDKDGKADPLALAAEKDGTPVFKLPKWRVKGKTIKEVAEAYRSVGAELNVLPFCTQFIPMDIIDSPKHGSIIYHPSILPRHRGASAINWTLIMGDKKAGFSVFWADDGLDTGPILLQRSCDVEPNDTVDALYNRFLFPEGIKAMVEAVQLIADGKAPRIPQPEEGATYEGIQKKENAEISWDQSAEVLHNWIRGHDKVPGAWTEINGQMVTFYGSTLLNSSVPPGEPLEIKGAKKPGLVTKNGLVLFGNDGKALTVRNLQFEDGKMIPASQYFSTGETSVVELTAEEVKVAETIKVIWAGILSNVPIIEDSTDFFKSGASSMDVARLVEEIRQKCGGLQLQNEDVYMATKFEGFIQKVVRKLRGEDQEVELVVDYISKEVNEIMVKMPYQCFINGQFTDADDGKTYDTINPTDGSTICKVSYASLADVDKAVAAAKDAFENGEWGRMNARERGRLMYRLADLLEENQEELATIEALDSGAVYTLALKTHIGMSVQTFRYFAGWCDKIQGSTIPINQARPNRNLTFTKKEPLGVCAIIIPWNYPLMMLAWKSAACLAAGNTLVLKPAQVTPLTALKFAELSVKAGFPKGVINIIPGSGGIAGQRLSEHPDIRKLGFTGSTPIGKQIMKSCAVSNLKKVSLELGGKSPLIIFNDCELDKAVRMGMGAVFFNKGENCIAAGRLFVEESIHDEFVTRVVEEIKKMKIGDPLDRSTDHGPQNHKAHLEKLLQYCETGVKEGATLVYGGRQVQRPGFFMEPTVFTDVEDYMYLAKEESFGPIMVISKFQNGDIDGVLQRANSTEYGLASGVFTRDINKAMYVSEKLEAGTVFINTYNKTDVAAPFGGVKQSGFGKDLGEEALNEYLKTKTVTLEY

SEQ ID NO: 3862 - protein, 92 aa, Homo sapiens
  Payload ID: 879;
  Gene Symbol: ALDH1L2;
  Gene Name: aldehyde dehydrogenase 1 family, member L2;
  ENSP ID: ENSP00000447464
  MOD_RES (1)..(1): Any amino acid
XVEEIKKMKIGDPLDRSTDHGPQNHKAHLEKLLQYCETGVKEGATLVYGGRQVQRPGFFMEPTVFTDVEDYMYLAKEESFGPIMVISKFQNG

SEQ ID NO: 3863 - protein, 203 aa, Homo sapiens
  Payload ID: 879;
  Gene Symbol: ALDH1L2;
  Gene Name: aldehyde dehydrogenase 1 family, member L2;
  Uniprot ID:  Q3SY69;
  ENSP ID: ENSP00000447538
MLRRGSQALRRFSTGRVYFKNKLKLALIGQSLFGQEVYSHLRKEGHRVVGVFTVPDKDGKADPLALAAEKDGTPVFKLPKWRVKGKTIKEVAEAYRSVGAELNVLPFCTQFIPMDIIDSPKHGSIIYHPSILPRHRGASAINWTLIMGDKKAGFSVFWADDGLDTGPILLQRSCDVEPNDTVDALYNRFLFPEGIKAMKLSNS

SEQ ID NO: 3864 - protein, 802 aa, Homo sapiens
  Payload ID: 880;
  Gene Symbol: ALDH16A1;
  Gene Name: aldehyde dehydrogenase 16 family, member A1;
  Uniprot ID:  Q8IZ83;
  ENSP ID: ENSP00000293350
MAATRAGPRAREIFTSLEYGPVPESHACALAWLDTQDRCLGHYVNGKWLKPEHRNSVPCQDPITGENLASCLQAQAEDVAAAVEAARMAFKGWSAHPGVVRAQHLTRLAEVIQKHQRLLWTLESLVTGRAVREVRDGDVQLAQQLLHYHAIQASTQEEALAGWEPMGVIGLILPPTFSFLEMMWRICPALAVGCTVVALVPPASPAPLLLAQLAGELGPFPGILNVLSGPASLVPILASQPGIRKVAFCGAPEEGRALRRSLAGECAELGLALGTESLLLLTDTADVDSAVEGVVDAAWSDRGPGGLRLLIQESVWDEAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 3865 - protein, 751 aa, Homo sapiens
  Payload ID: 880;
  Gene Symbol: ALDH16A1;
  Gene Name: aldehyde dehydrogenase 16 family, member A1;
  Uniprot ID:  Q8IZ83;
  ENSP ID: ENSP00000410142
MAATRAGPRAREIFTSLEYGPVPESHACALAWLDTQDRCLGHYVNGKWLKPEHRNSVPCQDPITGENLASCLQAQAEDVAAAVEAARMAFKGWSAHPGVVRAQHLTRLAEVIQKHQRLLWTLESLVTGRAVREVRDGDVQLAQQLLHYHAIQASTQEEALAGWEPMGVIGLILPPTFSFLEMMWRICPALAVGCTVVALVPPASPAPLLLAQLAGELGPFPGILNVLSGPASLVPILASQPGIRKVAFCGAPEGGLRLLIQESVWDEAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 3866 - protein, 639 aa, Homo sapiens
  Payload ID: 880;
  Gene Symbol: ALDH16A1;
  Gene Name: aldehyde dehydrogenase 16 family, member A1;
  ENSP ID: ENSP00000445088
MRTGVIGLILPPTFSFLEMMWRICPALAVGCTVVALVPPASPAPLLLAQLAGELGPFPGILNVLSGPASLVPILASQPGIRKVAFCGAPEEGRALRRSLAGECAELGLALGTESLLLLTDTADVDSAVEGVVDAAWSDRGPGGLRLLIQESVWDEAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 3867 - protein, 163 aa, Homo sapiens
  Payload ID: 880;
  Gene Symbol: ALDH16A1;
  Gene Name: aldehyde dehydrogenase 16 family, member A1;
  ENSP ID: ENSP00000469507
INAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRAGRASPQEPGQPCCGPWRLHWSAGSLPWPRGWRGRERSSRLRRRRWS

SEQ ID NO: 3868 - protein, 103 aa, Homo sapiens
  Payload ID: 880;
  Gene Symbol: ALDH16A1;
  Gene Name: aldehyde dehydrogenase 16 family, member A1;
  ENSP ID: ENSP00000470160
MAATRAGPRAREIFTSLEYGPVPESHACALAGRGDPEAPAAAVDPGIPGDWAGCSRGSRRGRPAGPAAAPLPCNPGIHPGGGTGRLGAHGSNWPHPATHILLP

SEQ ID NO: 3869 - protein, 793 aa, Homo sapiens
  Payload ID: 881;
  Gene Symbol: ALDH18A1;
  Gene Name: aldehyde dehydrogenase 18 family, member A1;
  Uniprot ID:  P54886;
  ENSP ID: ENSP00000360265
MLSQVYRCGFQPFNQHLLPWVKCTTVFRSHCIQPSVIRHVRSWSNIPFITVPLSRTHGKSFAHRSELKHAKRIVVKLGSAVVTRGDECGLALGRLASIVEQVSVLQNQGREMMLVTSGAVAFGKQRLRHEILLSQSVRQALHSGQNQLKEMAIPVLEARACAAAGQSGLMALYEAMFTQYSICAAQILVTNLDFHDEQKRRNLNGTLHELLRMNIVPIVNTNDAVVPPAEPNSDLQGVISVKDNDSLAARLAVEMKTDLLIVLSDVEGLFDSPPGSDDAKLIDIFYPGDQQSVTFGTKSRVGMGGMEAKVKAALWALQGGTSVVIANGTHPKVSGHVITDIVEGKKVGTFFSEVKPAGPTVEQQGEMARSGGRMLATLEPEQRAEIIHHLADLLTDQRDEILLANKKDLEEAEGRLAAPLLKRLSLSTSKLNSLAIGLRQIAASSQDSVGRVLRRTRIAKNLELEQVTVPIGVLLVIFESRPDCLPQVAALAIASGNGLLLKGGKEAAHSNRILHLLTQEALSIHGVKEAVQLVNTREEVEDLCRLDKMIDLIIPRGSSQLVRDIQKAAKGIPVMGHSEGICHMYVDSEASVDKVTRLVRDSKCEYPAACNALETLLIHRDLLRTPLFDQIIDMLRVEQVKIHAGPKFASYLTFSPSEVKSLRTEYGDLELCIEVVDNVQDAIDHIHKYGSSHTDVIVTEDENTAEFFLQHVDSACVFWNASTRFSDGYRFGLGAEVGISTSRIHARGPVGLEGLLTTKWLLRGKDHVVSDFSEHGSLKYLHENLPIPQRNTN

SEQ ID NO: 3870 - protein, 795 aa, Homo sapiens [sequence omitted]

SEQ ID NO: 3871 - protein, 517 aa, Homo sapiens
  Payload ID: 882;
  Gene Symbol: ALDH2;
  Gene Name: aldehyde dehydrogenase 2 family (mitochondrial);
  Uniprot ID:  P05091;
  ENSP ID: ENSP00000261733
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 3872 - protein, 470 aa, Homo sapiens
  Payload ID: 882;
  Gene Symbol: ALDH2;
  Gene Name: aldehyde dehydrogenase 2 family (mitochondrial);
  Uniprot ID:  P05091;
  ENSP ID: ENSP00000403349
MLRAAARFGPRLGRRLLSAAATQAVPAPNQQPEVFCNQIFINNEWHDAVSRKTFPTVNPSTGEVICQVAEGDKALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 3873 - protein, 79 aa, Homo sapiens
  Payload ID: 882;
  Gene Symbol: ALDH2;
  Gene Name: aldehyde dehydrogenase 2 family (mitochondrial);
  ENSP ID: ENSP00000448179
MLRAAARFGPRLGRRLLSAAATQAVPAPNQQPEVFCNQSRLKMSTPDITVLLETIKRKWELGHPPTTPRPRAFTCVIFS

SEQ ID NO: 3874 - protein, 117 aa, Homo sapiens
  Payload ID: 882;
  Gene Symbol: ALDH2;
  Gene Name: aldehyde dehydrogenase 2 family (mitochondrial);
  ENSP ID: ENSP00000474669
  MOD_RES (1)..(1): Any amino acid
XEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEGQLL

SEQ ID NO: 3875 - protein, 453 aa, Homo sapiens
  Payload ID: 883;
  Gene Symbol: ALDH3A1;
  Gene Name: aldehyde dehydrogenase 3 family, member A1;
  Uniprot ID:  P30838;
  ENSP ID: ENSP00000225740
MSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQH

SEQ ID NO: 3876 - protein, 389 aa, Homo sapiens
  Payload ID: 883;
  Gene Symbol: ALDH3A1;
  Gene Name: aldehyde dehydrogenase 3 family, member A1;
  ENSP ID: ENSP00000378923
MSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQH

SEQ ID NO: 3877 - protein, 259 aa, Homo sapiens
  Payload ID: 883;
  Gene Symbol: ALDH3A1;
  Gene Name: aldehyde dehydrogenase 3 family, member A1;
  ENSP ID: ENSP00000388369
MSKISEAVKRARAAFSSGRTRPLQFRIQQLEALQRLIQEQEQELNEWNAYYEEVVYVLEEIEYMIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLK

SEQ ID NO: 3878 - protein, 453 aa, Homo sapiens; identical to SEQ ID NO: 3875
  Payload ID: 883;
  Gene Symbol: ALDH3A1;
  Gene Name: aldehyde dehydrogenase 3 family, member A1;
  Uniprot ID:  P30838;
  ENSP ID: ENSP00000388469

SEQ ID NO: 3879 - protein, 372 aa, Homo sapiens
  Payload ID: 883;
  Gene Symbol: ALDH3A1;
  Gene Name: aldehyde dehydrogenase 3 family, member A1;
  ENSP ID: ENSP00000389766
MSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDK

SEQ ID NO: 3880 - protein, 453 aa, Homo sapiens; identical to SEQ ID NO: 3875
  Payload ID: 883;
  Gene Symbol: ALDH3A1;
  Gene Name: aldehyde dehydrogenase 3 family, member A1;
  Uniprot ID:  P30838;
  ENSP ID: ENSP00000411821

SEQ ID NO: 3881 - protein, 396 aa, Homo sapiens
  Payload ID: 883;
  Gene Symbol: ALDH3A1;
  Gene Name: aldehyde dehydrogenase 3 family, member A1;
  ENSP ID: ENSP00000434685
MSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKGTAAWDPTMARRASRLSLTAALAW

SEQ ID NO: 3882 - protein, 131 aa, Homo sapiens
  Payload ID: 883;
  Gene Symbol: ALDH3A1;
  Gene Name: aldehyde dehydrogenase 3 family, member A1;
  ENSP ID: ENSP00000458841
MSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAA

SEQ ID NO: 3883 - protein, 380 aa, Homo sapiens
  Payload ID: 883;
  Gene Symbol: ALDH3A1;
  Gene Name: aldehyde dehydrogenase 3 family, member A1;
  ENSP ID: ENSP00000460482
MIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQH

SEQ ID NO: 3884 - protein, 74 aa, Homo sapiens
  Payload ID: 883;
  Gene Symbol: ALDH3A1;
  Gene Name: aldehyde dehydrogenase 3 family, member A1;
  ENSP ID: ENSP00000460792
MSKISEAVKRARAAFSSGRTRPLQFRIQQLEALQRLIQEQEQELVGALAADLHKNEWNAYYEEVVYVLEEIEYM

SEQ ID NO: 3885 - protein, 119 aa, Homo sapiens
  Payload ID: 883;
  Gene Symbol: ALDH3A1;
  Gene Name: aldehyde dehydrogenase 3 family, member A1;
  ENSP ID: ENSP00000461189
MSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFN

SEQ ID NO: 3886 - protein, 485 aa, Homo sapiens
  Payload ID: 884;
  Gene Symbol: ALDH3A2;
  Gene Name: aldehyde dehydrogenase 3 family, member A2;
  Uniprot ID:  P51648;
  ENSP ID: ENSP00000176643
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKLIKRMIDETSSGGVTGNDVIMHFTLNSFPFGGVGSSGMGAYHGKHSFDTFSHQRPCLLKSLKREGANKLRYPPNSQSKVDWGKFFLLKRFNKEKLGLLLLTFLGIVAAVLVKAEYY

SEQ ID NO: 3887 - protein, 508 aa, Homo sapiens
  Payload ID: 884;
  Gene Symbol: ALDH3A2;
  Gene Name: aldehyde dehydrogenase 3 family, member A2;
  Uniprot ID:  P51648;
  ENSP ID: ENSP00000345774
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKLIKRMIDETSSGGVTGNDVIMHFTLNSFPFGGVGSSGMGAYHGKHSFDTFSHQRPCLLKSLKREGANKLRYPPNSQSKVDWGKFFLLKRFNKEKLGLLLLTFLGIVAAVLVKKYQAVLRRKALLIFLVVHRLRWSSKQR

SEQ ID NO: 3888 - protein, 485 aa, Homo sapiens; identical to SEQ ID NO: 3886
  Payload ID: 884;
  Gene Symbol: ALDH3A2;
  Gene Name: aldehyde dehydrogenase 3 family, member A2;
  Uniprot ID:  P51648;
  ENSP ID: ENSP00000378942

SEQ ID NO: 3889 - protein, 166 aa, Homo sapiens
  Payload ID: 884;
  Gene Symbol: ALDH3A2;
  Gene Name: aldehyde dehydrogenase 3 family, member A2;
  ENSP ID: ENSP00000395845
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGG

SEQ ID NO: 3890 - protein, 182 aa, Homo sapiens
  Payload ID: 884;
  Gene Symbol: ALDH3A2;
  Gene Name: aldehyde dehydrogenase 3 family, member A2;
  ENSP ID: ENSP00000458397
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQPFCSNSCDDPIKKDEMEDSEMSRIE

SEQ ID NO: 3891 - protein, 162 aa, Homo sapiens
  Payload ID: 884;
  Gene Symbol: ALDH3A2;
  Gene Name: aldehyde dehydrogenase 3 family, member A2;
  ENSP ID: ENSP00000458942
TTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIGNGNSPFPMGRWQFGSFC

SEQ ID NO: 3892 - protein, 97 aa, Homo sapiens
  Payload ID: 884;
  Gene Symbol: ALDH3A2;
  Gene Name: aldehyde dehydrogenase 3 family, member A2;
  ENSP ID: ENSP00000459977
MQEEIFGPILPIVPVKNVDEAINFINEREKPLALYVFSHNHKLIKRMIDETSSGGVTGNDVIMHFTLNSFPFGGVGRILLKNDPVQPPSASTELFLF

SEQ ID NO: 3893 - protein, 85 aa, Homo sapiens
  Payload ID: 884;
  Gene Symbol: ALDH3A2;
  Gene Name: aldehyde dehydrogenase 3 family, member A2;
  ENSP ID: ENSP00000461235
FSHQRPCLLKSLKREGANKLRYPPNSQSKVDWGKFFLLKRFNKEKLGLLLLTFLGIVAAVLVKFTDCVGPVSRDEHQISKPSPVC

SEQ ID NO: 3894 - protein, 508 aa, Homo sapiens; identical to SEQ ID NO: 3887
  Payload ID: 884;
  Gene Symbol: ALDH3A2;
  Gene Name: aldehyde dehydrogenase 3 family, member A2;
  Uniprot ID:  P51648;
  ENSP ID: ENSP00000461916

SEQ ID NO: 3895 - protein, 62 aa, Homo sapiens
  Payload ID: 884;
  Gene Symbol: ALDH3A2;
  Gene Name: aldehyde dehydrogenase 3 family, member A2;
  ENSP ID: ENSP00000462933
IFGPILPIVPVKNVDEAINFINEREKPLALYVFSHNHKVPVGWELITENIVLILFLISVPVY

SEQ ID NO: 3896 - protein, 146 aa, Homo sapiens
  Payload ID: 884;
  Gene Symbol: ALDH3A2;
  Gene Name: aldehyde dehydrogenase 3 family, member A2;
  ENSP ID: ENSP00000462964
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKI

SEQ ID NO: 3897 - protein, 54 aa, Homo sapiens
  Payload ID: 884;
  Gene Symbol: ALDH3A2;
  Gene Name: aldehyde dehydrogenase 3 family, member A2;
  ENSP ID: ENSP00000463128
MELEVRRVRQAFLSGRSRPLRFRLQQLEALRRMVQEREKDILTAIAADLCKEML

SEQ ID NO: 3898 - protein, 485 aa, Homo sapiens; identical to SEQ ID NO: 3886
  Payload ID: 884;
  Gene Symbol: ALDH3A2;
  Gene Name: aldehyde dehydrogenase 3 family, member A2;
  Uniprot ID:  P51648;
  ENSP ID: ENSP00000463637

SEQ ID NO: 3899 - protein, 58 aa, Homo sapiens
  Payload ID: 884;
  Gene Symbol: ALDH3A2;
  Gene Name: aldehyde dehydrogenase 3 family, member A2;
  ENSP ID: ENSP00000463924
  MOD_RES (1)..(1): Any amino acid
XLKREGANKLRYPPNSQSKVDWGKFFLLKRFNKEKLGLLLLTFLGIVAAVLVKTALVQ

SEQ ID NO: 3900 - protein, 393 aa, Homo sapiens
  Payload ID: 884;
  Gene Symbol: ALDH3A2;
  Gene Name: aldehyde dehydrogenase 3 family, member A2;
  ENSP ID: ENSP00000464153
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKVPVGWELITENIVLILFLISVPVY

SEQ ID NO: 3901 - protein, 134 aa, Homo sapiens
  Payload ID: 884;
  Gene Symbol: ALDH3A2;
  Gene Name: aldehyde dehydrogenase 3 family, member A2;
  ENSP ID: ENSP00000464453
  MOD_RES (1)..(1): Any amino acid
XKHLTPVTLELGGKSPCYIDKDCDLDIVCSCSGCFPLRRITWGKYMNCGQTCIAPDYILCEASLQNQIVWKIKETVKEFYGENIKESPDYERIINLRHFKRILSLLEGQKIAFGGETDEATRYIAPTVLTDVDP

SEQ ID NO: 3902 - protein, 126 aa, Homo sapiens
  Payload ID: 884;
  Gene Symbol: ALDH3A2;
  Gene Name: aldehyde dehydrogenase 3 family, member A2;
  ENSP ID: ENSP00000466814
MVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQD

SEQ ID NO: 3903 - protein, 393 aa, Homo sapiens; identical to SEQ ID NO: 3900
  Payload ID: 884;
  Gene Symbol: ALDH3A2;
  Gene Name: aldehyde dehydrogenase 3 family, member A2;
  ENSP ID: ENSP00000486085

SEQ ID NO: 3904 - protein, 182 aa, Homo sapiens; identical to SEQ ID NO: 3890
  Payload ID: 884;
  Gene Symbol: ALDH3A2;
  Gene Name: aldehyde dehydrogenase 3 family, member A2;
  ENSP ID: ENSP00000486283

SEQ ID NO: 3905 - protein, 97 aa, Homo sapiens; identical to SEQ ID NO: 3892
  Payload ID: 884;
  Gene Symbol: ALDH3A2;
  Gene Name: aldehyde dehydrogenase 3 family, member A2;
  ENSP ID: ENSP00000487353

SEQ ID NO: 3906 - protein, 468 aa, Homo sapiens
  Payload ID: 885;
  Gene Symbol: ALDH3B1;
  Gene Name: aldehyde dehydrogenase 3 family, member B1;
  Uniprot ID:  P43353;
  ENSP ID: ENSP00000473990
MDPLGDTLRRLREAFHAGRTRPAEFRAAQLQGLGRFLQENKQLLHDALAQDLHKSAFESEVSEVAISQGEVTLALRNLRAWMKDERVPKNLATQLDSAFIRKEPFGLVLIIAPWNYPLNLTLVPLVGALAAGNCVVLKPSEISKNVEKILAEVLPQYVDQSCFAVVLGGPQETGQLLEHRFDYIFFTGSPRVGKIVMTAAAKHLTPVTLELGGKNPCYVDDNCDPQTVANRVAWFRYFNAGQTCVAPDYVLCSPEMQERLLPALQSTITRFYGDDPQSSPNLGRIINQKQFQRLRALLGCGRVAIGGQSDESDRYIAPTVLVDVQEMEPVMQEEIFGPILPIVNVQSLDEAIEFINRREKPLALYAFSNSSQVVKRVLTQTSSGGFCGNDGFMHMTLASLPFGGVGASGMGRYHGKFSFDTFSHHRACLLRSPGMEKLNALRYPPQSPRRLRMLLVAMEAQGCSCTLL

SEQ ID NO: 3907 - protein, 66 aa, Homo sapiens
  Payload ID: 885;
  Gene Symbol: ALDH3B1;
  Gene Name: aldehyde dehydrogenase 3 family, member B1;
  ENSP ID: ENSP00000477789
LALRNLRAWMKDERVPKNLATQLDSAFIRKEPFGLVLIIAPWNYPLNLTLVPLVGALAAGSASESG

SEQ ID NO: 3908 - protein, 71 aa, Homo sapiens
  Payload ID: 885;
  Gene Symbol: ALDH3B1;
  Gene Name: aldehyde dehydrogenase 3 family, member B1;
  ENSP ID: ENSP00000478380
QSDESDRYIAPTVLVDVQEMEPVMQEEIFGPILPIVNVQSLDEAIEFINRREKPLALYAFSNSSQERIPQR

SEQ ID NO: 3909 - protein, 468 aa, Homo sapiens; identical to SEQ ID NO: 3906
  Payload ID: 885;
  Gene Symbol: ALDH3B1;
  Gene Name: aldehyde dehydrogenase 3 family, member B1;
  Uniprot ID:  P43353;
  ENSP ID: ENSP00000478486

SEQ ID NO: 3910 - protein, 169 aa, Homo sapiens
  Payload ID: 885;
  Gene Symbol: ALDH3B1;
  Gene Name: aldehyde dehydrogenase 3 family, member B1;
  ENSP ID: ENSP00000478632
MDPLGDTLRRLREAFHAGRTRPAEFRAAQLQGLGRFLQENKQLLHDALAQDLHKSAFESEVSEVAISQGEVTLALRNLRAWMKDERVPKNLATQLDSAFIRKEPFGLVLIIAPWNYPLNLTLVPLVGALAAGNCVVLKPSEISKNVEKILAEVLPQYVDQGALVWARLL

SEQ ID NO: 3911 - protein, 230 aa, Homo sapiens
  Payload ID: 885;
  Gene Symbol: ALDH3B1;
  Gene Name: aldehyde dehydrogenase 3 family, member B1;
  ENSP ID: ENSP00000479948
MDPLGDTLRRLREAFHAGRTRPAEFRAAQLQGLGRFLQENKQLLHDALAQDLHKSAFESEVSEVAISQGEVTLALRNLRAWMKDERVPKNLATQLDSAFIRKEPFGLVLIIAPWNYPLNLTLVPLVGALAAGNCVVLKPSEISKNVEKILAEVLPQYVDQSCFAVVLGGPQETGQLLEHRFDYIFFTGSPRVGKIVMTAAAKHPSKQRLPPPSWVFPLPASASSLSRSQP

SEQ ID NO: 3912 - protein, 431 aa, Homo sapiens
  Payload ID: 885;
  Gene Symbol: ALDH3B1;
  Gene Name: aldehyde dehydrogenase 3 family, member B1;
  Uniprot ID:  P43353;
  ENSP ID: ENSP00000481604
MDPLGDTLRRLREAFHAGRTRPAEFRAAQLQGLGRFLQENKQLLHDALAQDLHKATQLDSAFIRKEPFGLVLIIAPWNYPLNLTLVPLVGALAAGNCVVLKPSEISKNVEKILAEVLPQYVDQSCFAVVLGGPQETGQLLEHRFDYIFFTGSPRVGKIVMTAAAKHLTPVTLELGGKNPCYVDDNCDPQTVANRVAWFRYFNAGQTCVAPDYVLCSPEMQERLLPALQSTITRFYGDDPQSSPNLGRIINQKQFQRLRALLGCGRVAIGGQSDESDRYIAPTVLVDVQEMEPVMQEEIFGPILPIVNVQSLDEAIEFINRREKPLALYAFSNSSQVVKRVLTQTSSGGFCGNDGFMHMTLASLPFGGVGASGMGRYHGKFSFDTFSHHRACLLRSPGMEKLNALRYPPQSPRRLRMLLVAMEAQGCSCTLL

SEQ ID NO: 3913 - protein, 211 aa, Homo sapiens
  Payload ID: 885;
  Gene Symbol: ALDH3B1;
  Gene Name: aldehyde dehydrogenase 3 family, member B1;
  ENSP ID: ENSP00000483988
MAEGSGARVFMMDPLGDTLRRLREAFHAGRTRPAEFRAAQLQGLGRFLQENKQLLHDALAQDLHKSAFESEVSEVAISQGEVTLALRNLRAWMKDERVPKNLATQLDSAFIRKEPFGLVLIIAPWNYPLNLTLVPLVGALAAGNCVVLKPSEISKNVEKILAEVLPQYVDQSCFAVVLGGPQETGQLLEHRFDYIFFTGSPRVGKIVMTAA

SEQ ID NO: 3914 - protein, 351 aa, Homo sapiens
  Payload ID: 885;
  Gene Symbol: ALDH3B1;
  Gene Name: aldehyde dehydrogenase 3 family, member B1;
  ENSP ID: ENSP00000484901
MDPLGDTLRRLREAFHAGRTRPAEFRAAQLQGLGRFLQENKQLLHDALAQDLHKSAFESEVSEVAISQGEVTLALRNLRAWMKDERVPKNLATQLDSAFIRKEPFGLVLIIAPWNYPLNLTLVPLVGALAAGNCVVLKPSEISKNVEKILAEVLPQYVDQSSPNLGRIINQKQFQRLRALLGCGRVAIGGQSDESDRYIAPTVLVDVQEMEPVMQEEIFGPILPIVNVQSLDEAIEFINRREKPLALYAFSNSSQVVKRVLTQTSSGGFCGNDGFMHMTLASLPFGGVGASGMGRYHGKFSFDTFSHHRACLLRSPGMEKLNALRYPPQSPRRLRMLLVAMEAQGCSCTLL

SEQ ID NO: 3915 - protein, 385 aa, Homo sapiens
  Payload ID: 886;
  Gene Symbol: ALDH3B2;
  Gene Name: aldehyde dehydrogenase 3 family, member B2;
  Uniprot ID:  P48448;
  ENSP ID: ENSP00000255084
MKDEPRSTNLFMKLDSVFIWKEPFGLVLIIAPWNYPLNLTLVLLVGALAAGSCVVLKPSEISQGTEKVLAEVLPQYLDQSCFAVVLGGPQETGQLLEHKLDYIFFTGSPRVGKIVMTAATKHLTPVTLELGGKNPCYVDDNCDPQTVANRVAWFCYFNAGQTCVAPDYVLCSPEMQERLLPALQSTITRFYGDDPQSSPNLGHIINQKQFQRLRALLGCSRVAIGGQSNESDRYIAPTVLVDVQETEPVMQEEIFGPILPIVNVQSVDEAIKFINRQEKPLALYAFSNSSQVVNQMLERTSSGSFGGNEGFTYISLLSVPFGGVGHSGMGRYHGKFTFDTFSHHRTCLLAPSGLEKLKEIHYPPYTDWNQQLLRWGMGSQSCTLL

SEQ ID NO: 3916 - protein, 385 aa, Homo sapiens; identical to SEQ ID NO: 3915
  Payload ID: 886;
  Gene Symbol: ALDH3B2;
  Gene Name: aldehyde dehydrogenase 3 family, member B2;
  Uniprot ID:  P48448;
  ENSP ID: ENSP00000431595

SEQ ID NO: 3917 - protein, 94 aa, Homo sapiens
  Payload ID: 886;
  Gene Symbol: ALDH3B2;
  Gene Name: aldehyde dehydrogenase 3 family, member B2;
  ENSP ID: ENSP00000433466
MKDEPRSTNLFMKLDSVFIWKEPFGLVLIIAPWNYPLNLTLVLLVGALAAGSCVVLKPSEISQGTEKVLAEVLPQYLDQSCFAVVLGGPQETGQ

SEQ ID NO: 3918 - protein, 147 aa, Homo sapiens
  Payload ID: 886;
  Gene Symbol: ALDH3B2;
  Gene Name: aldehyde dehydrogenase 3 family, member B2;
  ENSP ID: ENSP00000433718
MKDEPRSTNLFMKLDSVFIWKEPFGLVLIIAPWNYPLNLTLVLLVGALAAGSCVVLKPSEISQGTEKVLAEVLPQYLDQSCFAVVLGGPQETGQLLEHKLDYIFFTGSPRVGKIVMTAATKHLTPVTLELGGKNPCYVDDNCDPQTV

SEQ ID NO: 3919 - protein, 128 aa, Homo sapiens
  Payload ID: 886;
  Gene Symbol: ALDH3B2;
  Gene Name: aldehyde dehydrogenase 3 family, member B2;
  ENSP ID: ENSP00000435476
  MOD_RES (1)..(1): Any amino acid
XSDRYIAPTVLVDVQETEPVMQEEIFGPILPIVNVQSVDEAIKFINRQEKPLALPQWDGPVPRQVHLRHLLPPPHLPARPLRPGEIKGDPLPTLYRLEPAAVTLGHGLPELHPPVSVPPASNGSHRET

SEQ ID NO: 3920 - protein, 563 aa, Homo sapiens
  Payload ID: 887;
  Gene Symbol: ALDH4A1;
  Gene Name: aldehyde dehydrogenase 4 family, member A1;
  Uniprot ID:  P30038;
  ENSP ID: ENSP00000290597
MLLPAPALRRALLSRPWTGAGLRWKHTSSLKVANEPVLAFTQGSPERDALQKALKDLKGRMEAIPCVVGDEEVWTSDVQYQVSPFNHGHKVAKFCYADKSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMGNVVLWKPSDTAMLASYAVYRILREAGLPPNIIQFVPADGPLFGDTVTSSEHLCGINFTGSVPTFKHLWKQVAQNLDRFHTFPRLAGECGGKNFHFVHRSADVESVVSGTLRSAFEYGGQKCSACSRLYVPHSLWPQIKGRLLEEHSRIKVGDPAEDFGTFFSAVIDAKSFARIKKWLEHARSSPSLTILAGGKCDDSVGYFVEPCIVESKDPQEPIMKEEIFGPVLSVYVYPDDKYKETLQLVDSTTSYGLTGAVFSQDKDVVQEATKVLRNAAGNFYINDKSTGSIVGQQPFGGARASGTNDKPGGPHYILRWTSPQVIKETHKPLGDWSYAYMQ

SEQ ID NO: 3921 - protein, 563 aa, Homo sapiens; identical to SEQ ID NO: 3920
  Payload ID: 887;
  Gene Symbol: ALDH4A1;
  Gene Name: aldehyde dehydrogenase 4 family, member A1;
  Uniprot ID:  P30038;
  ENSP ID: ENSP00000364490

SEQ ID NO: 3922 - protein, 214 aa, Homo sapiens
  Payload ID: 887;
  Gene Symbol: ALDH4A1;
  Gene Name: aldehyde dehydrogenase 4 family, member A1;
  ENSP ID: ENSP00000393209
MLLPAPALRRALLSRPWTGAGLRWKHTSSLKVANEPVLAFTQGSPERDALQKALKDLKGRMEAIPCVVGDEEVWTSDVQYQVSSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMVRCG

SEQ ID NO: 3923 - protein, 503 aa, Homo sapiens
  Payload ID: 887;
  Gene Symbol: ALDH4A1;
  Gene Name: aldehyde dehydrogenase 4 family, member A1;
  Uniprot ID:  P30038;
  ENSP ID: ENSP00000442988
MEAIPCVVGDEEVWTSDVQYQVSPFNHGHKVAKFCYADKSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMGNVVLWKPSDTAMLASYAVYRILREAGLPPNIIQFVPADGPLFGDTVTSSEHLCGINFTGSVPTFKHLWKQVAQNLDRFHTFPRLAGECGGKNFHFVHRSADVESVVSGTLRSAFEYGGQKCSACSRLYVPHSLWPQIKGRLLEEHSRIKVGDPAEDFGTFFSAVIDAKSFARIKKWLEHARSSPSLTILAGGKCDDSVGYFVEPCIVESKDPQEPIMKEEIFGPVLSVYVYPDDKYKETLQLVDSTTSYGLTGAVFSQDKDVVQEATKVLRNAAGNFYINDKSTGSIVGQQPFGGARASGTNDKPGGPHYILRWTSPQVIKETHKPLGDWSYAYMQ

SEQ ID NO: 3924 - protein, 512 aa, Homo sapiens
  Payload ID: 887;
  Gene Symbol: ALDH4A1;
  Gene Name: aldehyde dehydrogenase 4 family, member A1;
  Uniprot ID:  P30038;
  ENSP ID: ENSP00000446071
MLLPAPALRRALLSRPWTGAGLRWKHTSSLKVANEPVLAFTQGSPERDALQKALKDLKGRMEAIPCVVGDEEVWTSDVQYQVSPFNHGHKVAKFCYADKSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMGNVVLWKPSDTAMLASYAVYRILREAGLPPNIIQFVPADGPLFGDTVTSSEHLCGINFTGSVPTFKHLWKQVAQNLDRFHTFPRLAGECGGKNFHFVHRSADVESVVSGTLRSAFEYGGQKCSACSRLYVPHSLWPQIKGRLLEEHSRIKVGDPAEDFGTFFSAVIDAKEIFGPVLSVYVYPDDKYKETLQLVDSTTSYGLTGAVFSQDKDVVQEATKVLRNAAGNFYINDKSTGSIVGQQPFGGARASGTNDKPGGPHYILRWTSPQVIKETHKPLGDWSYAYMQ

SEQ ID NO: 3925 - protein, 548 aa, Homo sapiens
  Payload ID: 888;
  Gene Symbol: ALDH5A1;
  Gene Name: aldehyde dehydrogenase 5 family, member A1;
  Uniprot ID:  P51649;
  ENSP ID: ENSP00000314649
MATCIWLRSCGARRLGSTFPGCRLRPRAGGLVPASGPAPGPAQLRCYAGRLAGLSAALLRTDSFVGGRWLPAAATFPVQDPASGAALGMVADCGVREARAAVRAAYEAFCRWREVSAKERSSLLRKWYNLMIQNKDDLARIITAESGKPLKEAHGEILYSAFFLEWFSEEARRVYGDIIHTPAKDRRALVLKQPIGVAAVITPWNFPSAMITRKVGAALAAGCTVVVKPAEDTPFSALALAEVNQGFLLDLDPLLLASQAGIPSGVYNVIPCSRKNAKEVGEAICTDPLVSKISFTGSTTTGKILLHHAANSVKRVSMELGGLAPFIVFDSANVDQAVAGAMASKFRNTGQTCVCSNQFLVQRGIHDAFVKAFAEAMKKNLRVGNGFEEGTTQGPLINEKAVEKVEKQVNDAVSKGATVVTGGKRHQLGKNFFEPTLLCNVTQDMLCTHEETFGPLAPVIKFDTEEEAIAIANAADVGLAGYFYSQDPAQIWRVAEQLEVGMVGVNEGLISSVECPFGGVKQSGLGREGSKYGIDEYLELKYVCYGGL

SEQ ID NO: 3926 - protein, 535 aa, Homo sapiens
  Payload ID: 888;
  Gene Symbol: ALDH5A1;
  Gene Name: aldehyde dehydrogenase 5 family, member A1;
  Uniprot ID:  P51649;
  ENSP ID: ENSP00000350191
MATCIWLRSCGARRLGSTFPGCRLRPRAGGLVPASGPAPGPAQLRCYAGRLAGLSAALLRTDSFVGGRWLPAAATFPVQDPASGAALGMVADCGVREARAAVRAAYEAFCRWREVSAKERSSLLRKWYNLMIQNKDDLARIITAESGKPLKEAHGEILYSAFFLEWFSEEARRVYGDIIHTPAKDRRALVLKQPIGVAAVITPWNFPSAMITRKVGAALAAGCTVVVKPAEDTPFSALALAELASQAGIPSGVYNVIPCSRKNAKEVGEAICTDPLVSKISFTGSTTTGKILLHHAANSVKRVSMELGGLAPFIVFDSANVDQAVAGAMASKFRNTGQTCVCSNQFLVQRGIHDAFVKAFAEAMKKNLRVGNGFEEGTTQGPLINEKAVEKVEKQVNDAVSKGATVVTGGKRHQLGKNFFEPTLLCNVTQDMLCTHEETFGPLAPVIKFDTEEEAIAIANAADVGLAGYFYSQDPAQIWRVAEQLEVGMVGVNEGLISSVECPFGGVKQSGLGREGSKYGIDEYLELKYVCYGGL

SEQ ID NO: 3927 - protein, 507 aa, Homo sapiens
  Payload ID: 888;
  Gene Symbol: ALDH5A1;
  Gene Name: aldehyde dehydrogenase 5 family, member A1;
  ENSP ID: ENSP00000417687
MATCIWLRSCGARRLGSTFPGCRLRPRAGGLVPASGPAPGPAQLRCYAGRLAGLSAALLRTDSFVGGRWLPAAATFPVQDPASGAALGMVADCGVREARAAVRAAYEAFCRWREVSAKGKPLKEAHGEILYSAFFLEWFSEEARRVYGDIIHTPAKDRRALVLKQPIGVAAVITPWNFPSAMITRKVGAALAAGCTVVVKPAEDTPFSALALAELASQAGIPSGVYNVIPCSRKNAKEVGEAICTDPLVSKISFTGSTTTGKILLHHAANSVKRVSMELGGLAPFIVFDSANVDQAVAGAMASKFRNTGQTCVCSNQFLVQRGIHDAFVKAFAEAMKKNLRVGNGFEEGTTQGPLINEKAVEKVEKQVNDAVSKGATVVTGGKRHQLGKNFFEPTLLCNVTQDMLCTHEETFGPLAPVIKFDTEEEAIAIANAADVGLAGYFYSQDPAQIWRVAEQLEVGMVGVNEGLISSVECPFGGVKQSGLGREGSKYGIDEYLELKYVCYGGL

SEQ ID NO: 3928 - protein, 522 aa, Homo sapiens
  Payload ID: 889;
  Gene Symbol: ALDH6A1;
  Gene Name: aldehyde dehydrogenase 6 family, member A1;
  Uniprot ID:  Q02252;
  ENSP ID: ENSP00000342564
MAALLAAAAVRARILQVSSKVKSSPTWYSASSFSSSVPTVKLFIGGKFVESKSDKWIDIHNPATNEVIGRVPQATKAEMDAAIASCKRAFPAWADTSVLSRQQKEIAKLITLEQGKTLADAEGDVFRGLQVVEHACSVTSLMMGETMPSITKDMDLYSYRLPLGVCAGIAPFNFPAMIPLWMFPMAMVCGNTFLMKPSERVPGATMLLAKLLQDSGAPDGTLNIIHGQHEAVNFICDHPDIKAISFVGSNKAGEYIFERGSRHGKRVQANMGAKNHGVVMPDANKENTLNQLVGAAFGAAGQRCMALSTAVLVGEAKKWLPELVEHAKNLRVNAGDQPGADLGPLITPQAKERVCNLIDSGTKEGASILLDGRKIKVKGYENGNFVGPTIISNVKPNMTCYKEEIFGPVLVVLETETLDEAIQIVNNNPYGNGTAIFTTNGATARKYAHLVDVGQVGVNVPIPVPLPMFSFTGSRSSFRGDTNFYGKQGIQFYTQLKTITSQWKEEDATLSSPAVVMPTMGR

SEQ ID NO: 3929 - protein, 535 aa, Homo sapiens
  Payload ID: 889;
  Gene Symbol: ALDH6A1;
  Gene Name: aldehyde dehydrogenase 6 family, member A1;
  Uniprot ID:  Q02252;
  ENSP ID: ENSP00000450436
MAALLAAAAVRARILQVSSKVKSSPTWYSASSFSSSVPTVKLFIGGKFVESKSDKWIDIHNPATNEVIGRVPQATKAEMDAAIASCKRAFPAWADTSVLSRQQVLLRYQQLIKENLKEIAKLITLEQGKTLADAEGDVFRGLQVVEHACSVTSLMMGETMPSITKDMDLYSYRLPLGVCAGIAPFNFPAMIPLWMFPMAMVCGNTFLMKPSERVPGATMLLAKLLQDSGAPDGTLNIIHGQHEAVNFICDHPDIKAISFVGSNKAGEYIFERGSRHGKRVQANMGAKNHGVVMPDANKENTLNQLVGAAFGAAGQRCMALSTAVLVGEAKKWLPELVEHAKNLRVNAGDQPGADLGPLITPQAKERVCNLIDSGTKEGASILLDGRKIKVKGYENGNFVGPTIISNVKPNMTCYKEEIFGPVLVVLETETLDEAIQIVNNNPYGNGTAIFTTNGATARKYAHLVDVGQVGVNVPIPVPLPMFSFTGSRSSFRGDTNFYGKQGIQFYTQLKTITSQWKEEDATLSSPAVVMPTMGR

SEQ ID NO: 3930 - protein, 252 aa, Homo sapiens
  Payload ID: 889;
  Gene Symbol: ALDH6A1;
  Gene Name: aldehyde dehydrogenase 6 family, member A1;
  ENSP ID: ENSP00000452081
MGAKNHGVVMPDANKENTLNQLVGAAFGAAGQRCMALSTAVLVGEAKKWLPELVEHAKNLRVNAGDQPGADLGPLITPQAKERVCNLIDSGTKEGASILLDGRKIKVKGYENGNFVGPTIISNVKPNMTCYKEEIFGPVLVVLETETLDEAIQIVNNNPYGNGTAIFTTNGATARKYAHLVDVGQVGVNVPIPVPLPMFSFTGSRSSFRGDTNFYGKQGIQFYTQLKTITSQWKEEDATLSSPAVVMPTMGR

SEQ ID NO: 3931 - protein, 539 aa, Homo sapiens
  Payload ID: 890;
  Gene Symbol: ALDH7A1;
  Gene Name: aldehyde dehydrogenase 7 family, member A1;
  Uniprot ID:  P49419;
  ENSP ID: ENSP00000387123
MWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 3932 - protein, 97 aa, Homo sapiens
  Payload ID: 890;
  Gene Symbol: ALDH7A1;
  Gene Name: aldehyde dehydrogenase 7 family, member A1;
  ENSP ID: ENSP00000403929
MWRLPRALCVHAAKTSKLSGPWSRPAAFMSTLLINQPQYAWLKELGLREENEGVYNGSWGGRGEFASLDVPKSCHVVRWAVNSFEDWIFSISPLPRA

SEQ ID NO: 3933 - protein, 502 aa, Homo sapiens
  Payload ID: 890;
  Gene Symbol: ALDH7A1;
  Gene Name: aldehyde dehydrogenase 7 family, member A1;
  Uniprot ID:  P49419;
  ENSP ID: ENSP00000414132
MGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 3934 - protein, 77 aa, Homo sapiens
  Payload ID: 890;
  Gene Symbol: ALDH7A1;
  Gene Name: aldehyde dehydrogenase 7 family, member A1;
  ENSP ID: ENSP00000414536
MWRLPRALCVHAAKTSKLSGPWSRPAAFMSTLLINQPQYAWLKELGLREENEGVYNGSWGGRGEGLRFLYMIIILLF

SEQ ID NO: 3935 - protein, 239 aa, Homo sapiens
  Payload ID: 890;
  Gene Symbol: ALDH7A1;
  Gene Name: aldehyde dehydrogenase 7 family, member A1;
  ENSP ID: ENSP00000447388
RLPRALCVHAAKTSKLSGPWSRPAAFMSTLLINQPQYAWLKELGLREENEGVYNGSWGGRGEVITTYCPANNEPIARVRQASVADYEETVKKAREAWKIWADVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVN

SEQ ID NO: 3936 - protein, 475 aa, Homo sapiens
  Payload ID: 890;
  Gene Symbol: ALDH7A1;
  Gene Name: aldehyde dehydrogenase 7 family, member A1;
  ENSP ID: ENSP00000448593
MWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 3937 - protein, 141 aa, Homo sapiens
  Payload ID: 890;
  Gene Symbol: ALDH7A1;
  Gene Name: aldehyde dehydrogenase 7 family, member A1;
  ENSP ID: ENSP00000449318
MWRLPRALCVHAAKTSKLSGPWSRPAAFMSTLLINQPQYAWLKELGLREENEGVYNGSWGGRGEIPAPKRGEIVRQIGDALREKIQVLGSLVSLEMGKILVEGVGEVQEYVDICDYAVGLSRMIGGPILPSERSGHALIEQ

SEQ ID NO: 3938 - protein, 294 aa, Homo sapiens
  Payload ID: 890;
  Gene Symbol: ALDH7A1;
  Gene Name: aldehyde dehydrogenase 7 family, member A1;
  ENSP ID: ENSP00000487936
MWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFEQWK

SEQ ID NO: 3939 - protein, 27 aa, Homo sapiens
  Payload ID: 890;
  Gene Symbol: ALDH7A1;
  Gene Name: aldehyde dehydrogenase 7 family, member A1;
  ENSP ID: ENSP00000487998
  MOD_RES (1)..(1): Any amino acid
XELGLREENEGVYNGSWGGRGEDLAMH

SEQ ID NO: 3940 - protein, 41 aa, Homo sapiens
  Payload ID: 890;
  Gene Symbol: ALDH7A1;
  Gene Name: aldehyde dehydrogenase 7 family, member A1;
  ENSP ID: ENSP00000488032
  MOD_RES (1)..(1): Any amino acid
XSTLLINQPQYAWLKELGLREENEGVYNGSWGGRGEDLAMH

SEQ ID NO: 3941 - protein, 487 aa, Homo sapiens
  Payload ID: 891;
  Gene Symbol: ALDH8A1;
  Gene Name: aldehyde dehydrogenase 8 family, member A1;
  Uniprot ID:  Q9H2A2;
  ENSP ID: ENSP00000265605
MAGTNALLMLENFIDGKFLPCSSYIDSYDPSTGEVYCRVPNSGKDEIEAAVKAAREAFPSWSSRSPQERSRVLNQVADLLEQSLEEFAQAESKDQGKTLALARTMDIPRSVQNFRFFASSSLHHTSECTQMDHLGCMHYTVRAPVGVAGLISPWNLPLYLLTWKIAPAMAAGNTVIAKPSELTSVTAWMLCKLLDKAGVPPGVVNIVFGTGPRVGEALVSHPEVPLISFTGSQPTAERITQLSAPHCKKLSLELGGKNPAIIFEDANLDECIPATVRSSFANQGEICLCTSRIFVQKSIYSEFLKRFVEATRKWKVGIPSDPLVSIGALISKAHLEKVRSYVKRALAEGAQIWCGEGVDKLSLPARNQAGYFMLPTVITDIKDESCCMTEEIFGPVTCVVPFDSEEEVIERANNVKYGLAATVWSSNVGRVHRVAKKLQSGLVWTNCWLIRELNLPFGGMKSSGIGREGAKDSYDFFTEIKTITVKH

SEQ ID NO: 3942 - protein, 160 aa, Homo sapiens
  Payload ID: 891;
  Gene Symbol: ALDH8A1;
  Gene Name: aldehyde dehydrogenase 8 family, member A1;
  Uniprot ID:  Q9H2A2;
  ENSP ID: ENSP00000325473
MAGTNALLMLENFIDGKFLPCSSYIDSYDPSTGEVYCRVPNSGKDEIEAAVKAAREAFPSWSSRSPQERSRVLNQVADLLEQSLEEFAQAESKDQGKTLALARTMDIPRSVQNFRFFASSSLHHTSECTQMDHLGCMHYTVRAPVGVVPGYTCRTCRFVT

SEQ ID NO: 3943 - protein, 433 aa, Homo sapiens
  Payload ID: 891;
  Gene Symbol: ALDH8A1;
  Gene Name: aldehyde dehydrogenase 8 family, member A1;
  Uniprot ID:  Q9H2A2;
  ENSP ID: ENSP00000356819
MAGTNALLMLENFIDGKFLPCSSYIDSYDPSTGEVYCRVPNSGKDEIEAAVKAAREAFPSWSSRSPQERSRVLNQVADLLEQSLEEFAQAESKDQGKTLALARTMDIPRSVQNFRFFASSSLHHTSECTQMDHLGCMHYTVRAPVGVAGLISPWNLPLYLLTWKIAPAMAAGNTVIAKPSELTSVTAWMLCKLLDKAGVPPGVVNIVFGTGPRVGEALVSHPEVPLISFTGSQPTAERITQLSAPHCKKLSLELGGKNPAIIFEDANLDECIPATVRSSFANQVRSYVKRALAEGAQIWCGEGVDKLSLPARNQAGYFMLPTVITDIKDESCCMTEEIFGPVTCVVPFDSEEEVIERANNVKYGLAATVWSSNVGRVHRVAKKLQSGLVWTNCWLIRELNLPFGGMKSSGIGREGAKDSYDFFTEIKTITVKH

SEQ ID NO: 3944 - protein, 437 aa, Homo sapiens
  Payload ID: 891;
  Gene Symbol: ALDH8A1;
  Gene Name: aldehyde dehydrogenase 8 family, member A1;
  Uniprot ID:  Q9H2A2;
  ENSP ID: ENSP00000356821
MAGTNALLMLENFIDGKFLPCSSYIDSYDPSTGEVYCRVPNSGKDEIEAAVKAAREAFPSWSSRSPQERSRVLNQVADLLEQSLEEFAQAESKDQGKTLALARTMDIPRSVQNFRFFASSSLHHTSECTQMDHLGCMHYTVRAPVGVGVPPGVVNIVFGTGPRVGEALVSHPEVPLISFTGSQPTAERITQLSAPHCKKLSLELGGKNPAIIFEDANLDECIPATVRSSFANQGEICLCTSRIFVQKSIYSEFLKRFVEATRKWKVGIPSDPLVSIGALISKAHLEKVRSYVKRALAEGAQIWCGEGVDKLSLPARNQAGYFMLPTVITDIKDESCCMTEEIFGPVTCVVPFDSEEEVIERANNVKYGLAATVWSSNVGRVHRVAKKLQSGLVWTNCWLIRELNLPFGGMKSSGIGREGAKDSYDFFTEIKTITVKH

SEQ ID NO: 3945 - protein, 15 aa, Homo sapiens
  Payload ID: 891;
  Gene Symbol: ALDH8A1;
  Gene Name: aldehyde dehydrogenase 8 family, member A1;
  ENSP ID: ENSP00000435297
MDIPRSVQNFRFFAS

SEQ ID NO: 3946 - protein, 134 aa, Homo sapiens
  Payload ID: 891;
  Gene Symbol: ALDH8A1;
  Gene Name: aldehyde dehydrogenase 8 family, member A1;
  ENSP ID: ENSP00000437161
EFLKRFVEATRKWKVGIPSDPLVRSYVKRALAEGAQIWCGEGVDKLSLPARNQAGYFMLPTVITDIKDESCCMTEEIFGPVTCVVPFDSEEEVIERANNVKYGLAATVWSSNVGRVHRVAKKLQSGLVWTNCWL

SEQ ID NO: 3947 - protein, 518 aa, Homo sapiens
  Payload ID: 892;
  Gene Symbol: ALDH9A1;
  Gene Name: aldehyde dehydrogenase 9 family, member A1;
  Uniprot ID:  P49189;
  ENSP ID: ENSP00000346827
MFLRAGLAALSPLLRSLRPSPVAAMSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 3948 - protein, 193 aa, Homo sapiens
  Payload ID: 893;
  Gene Symbol: AOX1;
  Gene Name: aldehyde oxidase 1;
  ENSP ID: ENSP00000260930
SKNPKGTWKDWAQTAFDESINLSAVGYFRGYESDMNWEKGEGQPFEYFVYGAACSEVEIDCLTGDHKNIRTDIVMDVGCSINPAIDIGQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMIPRDEPG

SEQ ID NO: 3949 - protein, 1338 aa, Homo sapiens
  Payload ID: 893;
  Gene Symbol: AOX1;
  Gene Name: aldehyde oxidase 1;
  Uniprot ID:  Q06278;
  ENSP ID: ENSP00000363832
MDRASELLFYVNGRKVIEKNVDPETMLLPYLRKKLRLTGTKYGCGGGGCGACTVMISRYNPITKRIRHHPANACLIPICSLYGAAVTTVEGIGSTHTRIHPVQERIAKCHGTQCGFCTPGMVMSIYTLLRNHPEPTLDQLTDALGGNLCRCTGYRPIIDACKTFCKTSGCCQSKENGVCCLDQGINGLPEFEEGSKTSPKLFAEEEFLPLDPTQELIFPPELMIMAEKQSQRTRVFGSERMMWFSPVTLKELLEFKFKYPQAPVIMGNTSVGPEVKFKGVFHPVIISPDRIEELSVVNHAYNGLTLGAGLSLAQVKDILADVVQKLPEEKTQMYHALLKHLGTLAGSQIRNMASLGGHIISRHPDSDLNPILAVGNCTLNLLSKEGKRQIPLNEQFLSKCPNADLKPQEILVSVNIPYSRKWEFVSAFRQAQRQENALAIVNSGMRVFFGEGDGIIRELCISYGGVGPATICAKNSCQKLIGRHWNEQMLDIACRLILNEVSLLGSAPGGKVEFKRTLIISFLFKFYLEVSQILKKMDPVHYPSLADKYESALEDLHSKHHCSTLKYQNIGPKQHPEDPIGHPIMHLSGVKHATGEAIYCDDMPLVDQELFLTFVTSSRAHAKIVSIDLSEALSMPGVVDIMTAEHLSDVNSFCFFTEAEKFLATDKVFCVGQLVCAVLADSEVQAKRAAKRVKIVYQDLEPLILTIEESIQHNSSFKPERKLEYGNVDEAFKVVDQILEGEIHMGGQEHFYMETQSMLVVPKGEDQEMDVYVSTQFPKYIQDIVASTLKLPANKVMCHVRRVGGAFGGKVLKTGIIAAVTAFAANKHGRAVRCVLERGEDMLITGGRHPYLGKYKAGFMNDGRILALDMEHYSNAGASLDESLFVIEMGLLKMDNAYKFPNLRCRGWACRTNLPSNTAFRGFGFPQAALITESCITEVAAKCGLSPEKVRIINMYKEIDQTPYKQEINAKNLIQCWRECMAMSSYSLRKVAVEKFNAENYWKKKGLAMVPLKFPVGLGSRAAGQAAALVHIYLDGSVLVTHGGIEMGQGVHTKMIQVVSRELRMPMSNVHLRGTSTETVPNANISGGSVVADLNGLAVKDACQTLLKRLEPIISKNPKGTWKDWAQTAFDESINLSAVGYFRGYESDMNWEKGEGQPFEYFVYGAACSEVEIDCLTGDHKNIRTDIVMDVGCSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMIPRDEPGSYVPWNVPI

SEQ ID NO: 3950 - protein, 151 aa, Homo sapiens
  Payload ID: 893;
  Gene Symbol: AOX1;
  Gene Name: aldehyde oxidase 1;
  ENSP ID: ENSP00000392485
MLLPYLRKKLRLTGTKYGCGGGGCGACTVMISRYNPITKRIRHHPANACLIPICSLYGAAVTTVEGIGSTHTRIHPVQERIAKCHGTQCGFCTPGMVMSIYTLLRNHPEPTLDQLTDALGGNLCRCTGYRPIIDACKTFCKTSGCCQSKEN

SEQ ID NO: 3951 - protein, 190 aa, Homo sapiens
  Payload ID: 893;
  Gene Symbol: AOX1;
  Gene Name: aldehyde oxidase 1;
  ENSP ID: ENSP00000413326
YFVYGAACSEVEIDCLTGDHKNIRTDIVMDVGCSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMGAHGKPVRRTQEQVLLIQLHKIQPMLVA

SEQ ID NO: 3952 - protein, 325 aa, Homo sapiens
  Payload ID: 894;
  Gene Symbol: AKR1A1;
  Gene Name: aldo-keto reductase family 1, member A1 (aldehyde reductase);
  Uniprot ID:  P14550;
  ENSP ID: ENSP00000312606
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFERGDNPFPKNADGTICYDSTHYKETWKALEALVAKGLVQALGLSNFNSRQIDDILSVASVRPAVLQVECHPYLAQNELIAHCQARGLEVTAYSPLGSSDRAWRDPDEPVLLEEPVVLALAEKYGRSPAQILLRWQVQRKVICIPKSITPSRILQNIKVFDFTFSPEEMKQLNALNKNWRYIVPMLTVDGKRVPRDAGHPLYPFNDPY

SEQ ID NO: 3953 - protein, 325 aa, Homo sapiens; identical to SEQ ID NO: 3952
  Payload ID: 894;
  Gene Symbol: AKR1A1;
  Gene Name: aldo-keto reductase family 1, member A1 (aldehyde reductase);
  Uniprot ID:  P14550;
  ENSP ID: ENSP00000361140

SEQ ID NO: 3954 - protein, 147 aa, Homo sapiens
  Payload ID: 894;
  Gene Symbol: AKR1A1;
  Gene Name: aldo-keto reductase family 1, member A1 (aldehyde reductase);
  ENSP ID: ENSP00000398414
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFERGDNPFPKNADGTICYDSTHYKETWKAL

SEQ ID NO: 3955 - protein, 119 aa, Homo sapiens
  Payload ID: 894;
  Gene Symbol: AKR1A1;
  Gene Name: aldo-keto reductase family 1, member A1 (aldehyde reductase);
  ENSP ID: ENSP00000476713
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFE

SEQ ID NO: 3956 - protein, 140 aa, Homo sapiens
  Payload ID: 894;
  Gene Symbol: AKR1A1;
  Gene Name: aldo-keto reductase family 1, member A1 (aldehyde reductase);
  ENSP ID: ENSP00000476978
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFEWGCLSLRRGDNPFPKNADGTI

SEQ ID NO: 3957 - protein, 325 aa, Homo sapiens; identical to SEQ ID NO: 3952
  Payload ID: 894;
  Gene Symbol: AKR1A1;
  Gene Name: aldo-keto reductase family 1, member A1 (aldehyde reductase);
  Uniprot ID:  P14550;
  ENSP ID: ENSP00000480713

SEQ ID NO: 3958 - protein, 316 aa, Homo sapiens
  Payload ID: 895;
  Gene Symbol: AKR1B1;
  Gene Name: aldo-keto reductase family 1, member B1 (aldose reductase);
  Uniprot ID:  P15121;
  ENSP ID: ENSP00000285930
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLLEDPRIKAIAAKHNKTTAQVLIRFPMQRNLVVIPKSVTPERIAENFKVFDFELSSQDMTTLLSYNRNWRVCALLSCTSHKDYPFHEEF

SEQ ID NO: 3959 - protein, 102 aa, Homo sapiens
  Payload ID: 895;
  Gene Symbol: AKR1B1;
  Gene Name: aldo-keto reductase family 1, member B1 (aldose reductase);
  ENSP ID: ENSP00000413205
MASRLLLNNGAKMPILGLGTWKSPPGQVTEAVKVAIDVGYRHIDCAHVYQNENEVGVAIQEKLREQVVKREELFIVSKPGSCLVAGNDDMCPLAGLAVVHVP

SEQ ID NO: 3960 - protein, 263 aa, Homo sapiens
  Payload ID: 895;
  Gene Symbol: AKR1B1;
  Gene Name: aldo-keto reductase family 1, member B1 (aldose reductase);
  ENSP ID: ENSP00000414399
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLLEDPRIKAIAAKHNKTTAQVQPLQVLLTVHNCLHS

SEQ ID NO: 3961 - protein, 316 aa, Homo sapiens
  Payload ID: 896;
  Gene Symbol: AKR1B10;
  Gene Name: aldo-keto reductase family 1, member B10 (aldose reductase);
  Uniprot ID:  O60218;
  ENSP ID: ENSP00000352584
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHKKTAAQVLIRFHIQRNVIVIPKSVTPARIVENIQVFDFKLSDEEMATILSFNRNWRACNVLQSSHLEDYPFNAEY

SEQ ID NO: 3962 - protein, 344 aa, Homo sapiens
  Payload ID: 897;
  Gene Symbol: AKR1B15;
  Gene Name: aldo-keto reductase family 1, member B15;
  Uniprot ID:  C9JRZ8;
  ENSP ID: ENSP00000389289
MVLQMEPQVNSTNNFHQGPLDQPVGPLTGLKSSLLKDTTSAGPLLRPYPASLLGKVKEAVKVAIDAEYRHIDCAYFYENQHEVGEAIQEKIQEKAVMREDLFIVSKVWPTFFERPLVRKAFEKTLKDLKLSYLDVYLIHWPQGFKTGDDFFPKDDKGNMISGKGTFLDAWEAMEELVDEGLVKALGVSNFNHFQIERLLNKPGLKYKPVTNQVECHPYLTQEKLIQYCHSKGITVTAYSPLGSPDRPWAKPEDPSLLEDPKIKEIAAKHKKTTAQVLIRFHIQRNVTVIPKSMTPAHIVENIQVFDFKLSDEEMATILSFNRNWRAFDFKEFSHLEDFPFDAEY

SEQ ID NO: 3963 - protein, 344 aa, Homo sapiens; identical to SEQ ID NO: 3962
  Payload ID: 897;
  Gene Symbol: AKR1B15;
  Gene Name: aldo-keto reductase family 1, member B15;
  Uniprot ID:  C9JRZ8;
  ENSP ID: ENSP00000397009

SEQ ID NO: 3964 - protein, 205 aa, Homo sapiens
  Payload ID: 898;
  Gene Symbol: AKR1C1;
  Gene Name: aldo-keto reductase family 1, member C1;
  ENSP ID: ENSP00000370240
MGVVSLFLCIVEQIFTSSKKIQFRGIFMAKVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQPRDNSIFSLSPDW

SEQ ID NO: 3965 - protein, 323 aa, Homo sapiens
  Payload ID: 898;
  Gene Symbol: AKR1C1;
  Gene Name: aldo-keto reductase family 1, member C1;
  Uniprot ID:  Q04828;
  ENSP ID: ENSP00000370254
MDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 3966 - protein, 324 aa, Homo sapiens
  Payload ID: 898;
  Gene Symbol: AKR1C1;
  Gene Name: aldo-keto reductase family 1, member C1;
  ENSP ID: ENSP00000412248
MDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEVMEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDMYFASHPNYPYSDEY

SEQ ID NO: 3967 - protein, 248 aa, Homo sapiens
  Payload ID: 898;
  Gene Symbol: AKR1C1;
  Gene Name: aldo-keto reductase family 1, member C1;
  ENSP ID: ENSP00000416415
  MOD_RES (1)..(1): Any amino acid
XSKYQCVKLNDGHFMPVLGFGTYAPAEVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNV

SEQ ID NO: 3968 - protein, 323 aa, Homo sapiens
  Payload ID: 899;
  Gene Symbol: AKR1C2;
  Gene Name: aldo-keto reductase family 1, member C2;
  Uniprot ID:  P52895;
  ENSP ID: ENSP00000370129
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 3969 - protein, 323 aa, Homo sapiens
  Payload ID: 899;
  Gene Symbol: AKR1C2;
  Gene Name: aldo-keto reductase family 1, member C2;
  ENSP ID: ENSP00000385221
MDPKYQCVELNDGHFMPVLGFGTCVPPEVPRNRVVEVTKLAIEAGFFHIDSAHLYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDILAGHPDYPFSGEY

SEQ ID NO: 3970 - protein, 297 aa, Homo sapiens
  Payload ID: 899;
  Gene Symbol: AKR1C2;
  Gene Name: aldo-keto reductase family 1, member C2;
  ENSP ID: ENSP00000392694
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 3971 - protein, 139 aa, Homo sapiens
  Payload ID: 899;
  Gene Symbol: AKR1C2;
  Gene Name: aldo-keto reductase family 1, member C2;
  Uniprot ID:  P52895;
  ENSP ID: ENSP00000408440
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKEDIGILTWKKSPKHNS

SEQ ID NO: 3972 - protein, 200 aa, Homo sapiens
  Payload ID: 899;
  Gene Symbol: AKR1C2;
  Gene Name: aldo-keto reductase family 1, member C2;
  ENSP ID: ENSP00000474566
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQR

SEQ ID NO: 3973 - protein, 323 aa, Homo sapiens
  Payload ID: 900;
  Gene Symbol: AKR1C3;
  Gene Name: aldo-keto reductase family 1, member C3;
  Uniprot ID:  P42330;
  ENSP ID: ENSP00000369927
MDSKHQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 3974 - protein, 155 aa, Homo sapiens
  Payload ID: 900;
  Gene Symbol: AKR1C3;
  Gene Name: aldo-keto reductase family 1, member C3;
  ENSP ID: ENSP00000474188
MQISQVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILN

SEQ ID NO: 3975 - protein, 300 aa, Homo sapiens
  Payload ID: 900;
  Gene Symbol: AKR1C3;
  Gene Name: aldo-keto reductase family 1, member C3;
  ENSP ID: ENSP00000474882
MQISQVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 3976 - protein, 323 aa, Homo sapiens
  Payload ID: 901;
  Gene Symbol:;
  Gene Name: aldo-keto reductase family 1, member C3 [Source:EntrezGene;Acc:8644];
  ENSP ID: ENSP00000401327
MDSKHQCLKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 3977 - protein, 323 aa, Homo sapiens
  Payload ID: 902;
  Gene Symbol: AKR1C4;
  Gene Name: aldo-keto reductase family 1, member C4;
  Uniprot ID:  P17516;
  ENSP ID: ENSP00000263126
MDPKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKPGETPLPKDENGKVIFDTVDLSATWEVMEKCKDAGLAKSIGVSNFNCRQLEMILNKPGLKYKPVCNQVECHPYLNQSKLLDFCKSKDIVLVAHSALGTQRHKLWVDPNSPVLLEDPVLCALAKKHKQTPALIALRYQLQRGVVVLAKSYNEQRIRENIQVFEFQLTSEDMKVLDGLNRNYRYVVMDFLMDHPDYPFSDEY

SEQ ID NO: 3978 - protein, 323 aa, Homo sapiens; identical to SEQ ID NO: 3977
  Payload ID: 902;
  Gene Symbol: AKR1C4;
  Gene Name: aldo-keto reductase family 1, member C4;
  Uniprot ID:  P17516;
  ENSP ID: ENSP00000369814

SEQ ID NO: 3979 - protein, 326 aa, Homo sapiens
  Payload ID: 903;
  Gene Symbol: AKR1D1;
  Gene Name: aldo-keto reductase family 1, member D1;
  Uniprot ID:  P51857;
  ENSP ID: ENSP00000242375
MDLSAASHRIPLSDGNSIPIIGLGTYSEPKSTPKGACATSVKVAIDTGYRHIDGAYIYQNEHEVGEAIREKIAEGKVRREDIFYCGKLWATNHVPEMVRPTLERTLRVLQLDYVDLYIIEVPMAFKPGDEIYPRDENGKWLYHKSNLCATWEAMEACKDAGLVKSLGVSNFNRRQLELILNKPGLKHKPVSNQVECHPYFTQPKLLKFCQQHDIVITAYSPLGTSRNPIWVNVSSPPLLKDALLNSLGKRYNKTAAQIVLRFNIQRGVVVIPKSFNLERIKENFQIFDFSLTEEEMKDIEALNKNVRFVELLMWRDHPEYPFHDEY

SEQ ID NO: 3980 - protein, 290 aa, Homo sapiens
  Payload ID: 903;
  Gene Symbol: AKR1D1;
  Gene Name: aldo-keto reductase family 1, member D1;
  Uniprot ID:  P51857;
  ENSP ID: ENSP00000389197
MDLSAASHRIPLSDGNSIPIIGLGTYSEPKSTPKGACATSVKVAIDTGYRHIDGAYIYQNEHEVGEAIREKIAEGKVRREDIFYCGKLWATNHVPEMVRPTLERTLRVLQLDYVDLYIIEVPMAFKPGDEIYPRDENGKWLYHKSNLCATWEAMEACKDAGLVKSLGVSNFNRRQLELILNKPGLKHKPVSNQVECHPYFTQPKLLKFCQQHDIVITAYSPLGTSRNPIWVNVSSPPLLKDALLNSLGKRYNKTAAQIVLRFNIQRGVVVIPKSFNLERIKENFQVARSS

SEQ ID NO: 3981 - protein, 96 aa, Homo sapiens
  Payload ID: 903;
  Gene Symbol: AKR1D1;
  Gene Name: aldo-keto reductase family 1, member D1;
  ENSP ID: ENSP00000397042
MDLSAASHRIPLSDGNSIPIIGLGTYSEPKSLWATNHVPEMVRPTLERTLRVLQLDYVDLYIIEVPMAFKPGDEIYPRDENGKWLYHKSNLCATWE

SEQ ID NO: 3982 - protein, 285 aa, Homo sapiens
  Payload ID: 903;
  Gene Symbol: AKR1D1;
  Gene Name: aldo-keto reductase family 1, member D1;
  Uniprot ID:  P51857;
  ENSP ID: ENSP00000402374
MDLSAASHRIPLSDGNSIPIIGLGTYSEPKSTPKGACATSVKVAIDTGYRHIDGAYIYQNEHEVGEAIREKIAEGKVRREDIFYCGKLWATNHVPEMVRPTLERTLRVLQLDYVDLYIIEVPMAFKPGDEIYPRDENGKWLYHKSNLCATWEVECHPYFTQPKLLKFCQQHDIVITAYSPLGTSRNPIWVNVSSPPLLKDALLNSLGKRYNKTAAQIVLRFNIQRGVVVIPKSFNLERIKENFQIFDFSLTEEEMKDIEALNKNVRFVELLMWRDHPEYPFHDEY

SEQ ID NO: 3983 - protein, 320 aa, Homo sapiens
  Payload ID: 904;
  Gene Symbol: AKR1E2;
  Gene Name: aldo-keto reductase family 1, member E2;
  Uniprot ID:  Q96JD6;
  ENSP ID: ENSP00000298375
MGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQIECHPYLTQKNLISFCQSRDVSVTAYRPLGGSCEGVDLIDNPVIKRIAKEHGKSPAQILIRFQIQRNVIVIPGSITPSHIKENIQVFDFELTQHDMDNILSLNRNLRLAMFPITKNHKDYPFHIEY

SEQ ID NO: 3984 - protein, 263 aa, Homo sapiens
  Payload ID: 904;
  Gene Symbol: AKR1E2;
  Gene Name: aldo-keto reductase family 1, member E2;
  Uniprot ID:  Q96JD6;
  ENSP ID: ENSP00000335034
MGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQILIRFQIQRNVIVIPGSITPSHIKENIQVFDFELTQHDMDNILSLNRNLRLAMFPITKNHKDYPFHIEY

SEQ ID NO: 3985 - protein, 222 aa, Homo sapiens
  Payload ID: 904;
  Gene Symbol: AKR1E2;
  Gene Name: aldo-keto reductase family 1, member E2;
  Uniprot ID:  Q96JD6;
  ENSP ID: ENSP00000335603
MGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEILIRFQIQRNVIVIPGSITPSHIKENIQVFDFELTQHDMDNILSLNRNLRLAMFPITKNHKDYPFHIEY

SEQ ID NO: 3986 - protein, 56 aa, Homo sapiens
  Payload ID: 904;
  Gene Symbol: AKR1E2;
  Gene Name: aldo-keto reductase family 1, member E2;
  ENSP ID: ENSP00000431625
  MOD_RES (1)..(1): Any amino acid
XDVSVTAYRPLGGSCEGVDLIDNPVIKRIAKEHDFDPISNPEECDSDPRIYHPKSH

SEQ ID NO: 3987 - protein, 250 aa, Homo sapiens
  Payload ID: 904;
  Gene Symbol: AKR1E2;
  Gene Name: aldo-keto reductase family 1, member E2;
  Uniprot ID:  Q96JD6;
  ENSP ID: ENSP00000432947
MGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQILIRFQIQRNVIVIPGSITPSHIKENIQVFDFELTQHDMDNILSLNRNLRLAMFPM

SEQ ID NO: 3988 - protein, 37 aa, Homo sapiens
  Payload ID: 904;
  Gene Symbol: AKR1E2;
  Gene Name: aldo-keto reductase family 1, member E2;
  ENSP ID: ENSP00000433496
  MOD_RES (1)..(1): Any amino acid
XSLKALKLNYLDLYLIHWPMGFKVPFTSSSRMDHELQ

SEQ ID NO: 3989 - protein, 203 aa, Homo sapiens
  Payload ID: 904;
  Gene Symbol: AKR1E2;
  Gene Name: aldo-keto reductase family 1, member E2;
  ENSP ID: ENSP00000434437
MGFKPPHPEWIMSCSELSFCLSHPRVQDLPLDESNMVIPSDTDFLDTWEAMEDLVITGLVKNIGVSNFNHEQLERLLNKPGLRFKPLTNQIECHPYLTQKNLISFCQSRDVSVTAYRPLGGSCEGVDLIDNPVIKRIAKEHGKSPAQILIRFQIQRNVIVIPGSITPSHIKENIQVFDFELTQHDMDNILSLNRNLRLAMFPM

SEQ ID NO: 3990 - protein, 198 aa, Homo sapiens
  Payload ID: 904;
  Gene Symbol: AKR1E2;
  Gene Name: aldo-keto reductase family 1, member E2;
  ENSP ID: ENSP00000435436
MQVIFSTAPWPNLPRAQASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQ

SEQ ID NO: 3991 - protein, 307 aa, Homo sapiens
  Payload ID: 904;
  Gene Symbol: AKR1E2;
  Gene Name: aldo-keto reductase family 1, member E2;
  Uniprot ID:  Q96JD6;
  ENSP ID: ENSP00000436794
MGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQIECHPYLTQKNLISFCQSRDVSVTAYRPLGGSCEGVDLIDNPVIKRIAKEHGKSPAQILIRFQIQRNVIVIPGSITPSHIKENIQVFDFELTQHDMDNILSLNRNLRLAMFPM

SEQ ID NO: 3992 - protein, 359 aa, Homo sapiens
  Payload ID: 905;
  Gene Symbol: AKR7A2;
  Gene Name: aldo-keto reductase family 7, member A2;
  Uniprot ID:  O43488;
  ENSP ID: ENSP00000235835
MLSAASRVVSRAAVHCALRSPPPEARALAMSRPPPPRVASVLGTMEMGRRMDAPASAAAVRAFLERGHTELDTAFMYSDGQSETILGGLGLGLGGGDCRVKIATKANPWDGKSLKPDSVRSQLETSLKRLQCPQVDLFYLHAPDHGTPVEETLHACQRLHQEGKFVELGLSNYASWEVAEICTLCKSNGWILPTVYQGMYNATTRQVETELFPCLRHFGLRFYAYNPLAGGLLTGKYKYEDKDGKQPVGRFFGNSWAETYRNRFWKEHHFEAIALVEKALQAAYGASAPSVTSAALRWMYHHSQLQGAHGDAVILGMSSLEQLEQNLAATEEGPLEPAVVDAFNQAWHLVAHECPNYFR

SEQ ID NO: 3993 - protein, 314 aa, Homo sapiens
  Payload ID: 905;
  Gene Symbol: AKR7A2;
  Gene Name: aldo-keto reductase family 7, member A2;
  ENSP ID: ENSP00000339084
RAAVHCALRSPPPEARALAMSRPPPPRVASVLGTMEMGRRMDAPASAAAVRAFLERGHTELDTAFMYSDGQSETILGGLGLGLGGGDCRVKIATKANPWDGKSLKPDSVRSQLETSLKRLQCPQVDLFYLHAPDHGTPVEETLHACQRLHQEGMYNATTRQVETELFPCLRHFGLRFYAYNPLAGGLLTGKYKYEDKDGKQPVGRFFGNSWAETYRNRFWKEHHFEAIALVEKALQAAYGASAPSVTSAALRWMYHHSQLQGAHGDAVILGMSSLEQLEQNLAATEEGPLEPAVVDAFNQAWHLVAHECPNYFR

SEQ ID NO: 3994 - protein, 55 aa, Homo sapiens
  Payload ID: 905;
  Gene Symbol: AKR7A2;
  Gene Name: aldo-keto reductase family 7, member A2;
  ENSP ID: ENSP00000417891
GTPVEETLHACQRLHQEGKFVELGLSNYASWEVAEICTLCKSNGWILPTVYQGAC

SEQ ID NO: 3995 - protein, 205 aa, Homo sapiens
  Payload ID: 905;
  Gene Symbol: AKR7A2;
  Gene Name: aldo-keto reductase family 7, member A2;
  ENSP ID: ENSP00000419936
  MOD_RES (1)..(1): Any amino acid
XAFMYSDGQSETILGGLGLGLGGGDCRVKIATKANPWDGKSLKPDSVRSQLETSLKRLQCPQVDLFYLHAPDHGTPVEETLHACQRLHQEGKFVELGLSNYASWEVAEICTLCKSNGWILPTVYQLLEGAPLRGHCVGGEGPAGRIWRQRPQCDLGCPPVDVPPLTAAGCPRGRGHPGHVQPGAAGAELGSNRGRAPGAGCRGCL

SEQ ID NO: 3996 - protein, 331 aa, Homo sapiens
  Payload ID: 906;
  Gene Symbol: AKR7A3;
  Gene Name: aldo-keto reductase family 7, member A3 (aflatoxin aldehyde reductase);
  Uniprot ID:  O95154;
  ENSP ID: ENSP00000355377
MSRQLSRARPATVLGAMEMGRRMDAPTSAAVTRAFLERGHTEIDTAFVYSEGQSETILGGLGLRLGGSDCRVKIDTKAIPLFGNSLKPDSLRFQLETSLKRLQCPRVDLFYLHMPDHSTPVEETLRACHQLHQEGKFVELGLSNYAAWEVAEICTLCKSNGWILPTVYQGMYNAITRQVETELFPCLRHFGLRFYAFNPLAGGLLTGKYKYEDKNGKQPVGRFFGNTWAEMYRNRYWKEHHFEGIALVEKALQAAYGASAPSMTSATLRWMYHHSQLQGAHGDAVILGMSSLEQLEQNLAAAEEGPLEPAVVDAFNQAWHLVTHECPNYFR

SEQ ID NO: 3997 - protein, 204 aa, Homo sapiens
  Payload ID: 907;
  Gene Symbol: AKR7L;
  Gene Name: aldo-keto reductase family 7-like ( gene/pseudogene);
  ENSP ID: ENSP00000402491
  MOD_RES (1)..(1): Any amino acid
XAFLYSDGQSETILGGLGLRMGSSDCRVKIATKANPWIGNSLKPDSVRSQLETSLKRLQCPVDLFYLHAPDHSAPVEETLRACHQLHQEGKFVELGLSNYAAWEVAEICTLCKSNGWILPTVYQLLEGAPLRGHCPGGEGPAGRVWRQRSQHDLGRPPVDVPPLTAAGCPRGRGHPGHVQPGAAGAELGSGRGRAPGAGCRGRL

SEQ ID NO: 3998 - protein, 330 aa, Homo sapiens
  Payload ID: 907;
  Gene Symbol: AKR7L;
  Gene Name: aldo-keto reductase family 7-like ( gene/pseudogene);
  Uniprot ID:  Q8NHP1;
  ENSP ID: ENSP00000406430
MSRQLSRARPATVLGAMEMGRRMDAPTSAAVTRAFLERGHTEIDTAFLYSDGQSETILGGLGLRMGSSDCRVKIATKANPWIGNSLKPDSVRSQLETSLKRLQCPVDLFYLHAPDHSAPVEETLRACHQLHQEGKFVELGLSNYAAWEVAEICTLCKSNGWILPTVYQGMYSATTRQVETELFPCLRHFGLRFYAYNPLAGGLLTGKYKYEDKDGKQPVGRFFGTQWAEIYRNHFWKEHHFEGIALVEKALQAAYGASAPSMTSAALRWMYHHSQLQGAHGDAVILGMSSLEQLEQNLAAAEEGPLEPAVVDAFNQAWHLFAHECPNYFI

SEQ ID NO: 3999 - protein, 330 aa, Homo sapiens; identical to SEQ ID NO: 3998
  Payload ID: 907;
  Gene Symbol: AKR7L;
  Gene Name: aldo-keto reductase family 7-like ( gene/pseudogene);
  ENSP ID: ENSP00000411913

SEQ ID NO: 4000 - protein, 364 aa, Homo sapiens
  Payload ID: 908;
  Gene Symbol: ALDOA;
  Gene Name: aldolase A, fructose-bisphosphate;
  Uniprot ID:  P04075;
  ENSP ID: ENSP00000336927
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 4001 - protein, 368 aa, Homo sapiens
  Payload ID: 908;
  Gene Symbol: ALDOA;
  Gene Name: aldolase A, fructose-bisphosphate;
  ENSP ID: ENSP00000378661
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQVGLQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 4002 - protein, 418 aa, Homo sapiens
  Payload ID: 908;
  Gene Symbol: ALDOA;
  Gene Name: aldolase A, fructose-bisphosphate;
  Uniprot ID:  P04075;
  ENSP ID: ENSP00000378669
MARRKPEGSSFNMTHLSMAMAFSFPPVASGQLHPQLGNTQHQTELGKELATTSTMPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 4003 - protein, 364 aa, Homo sapiens; identical to SEQ ID NO: 4000
  Payload ID: 908;
  Gene Symbol: ALDOA;
  Gene Name: aldolase A, fructose-bisphosphate;
  Uniprot ID:  P04075;
  ENSP ID: ENSP00000400452

SEQ ID NO: 4004 - protein, 140 aa, Homo sapiens
  Payload ID: 908;
  Gene Symbol: ALDOA;
  Gene Name: aldolase A, fructose-bisphosphate;
  ENSP ID: ENSP00000454499
MPYQYPALTPEQKKELSDIAHRIVAPGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCV

SEQ ID NO: 4005 - protein, 278 aa, Homo sapiens
  Payload ID: 908;
  Gene Symbol: ALDOA;
  Gene Name: aldolase A, fructose-bisphosphate;
  ENSP ID: ENSP00000455455
MARRKPEGSSFNMTHLSMAMAFSFPPVASGQLHPQLGNTQHQTELGKELATTSTMPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYL

SEQ ID NO: 4006 - protein, 364 aa, Homo sapiens; identical to SEQ ID NO: 4000
  Payload ID: 908;
  Gene Symbol: ALDOA;
  Gene Name: aldolase A, fructose-bisphosphate;
  Uniprot ID:  P04075;
  ENSP ID: ENSP00000455700

SEQ ID NO: 4007 - protein, 364 aa, Homo sapiens; identical to SEQ ID NO: 4000
  Payload ID: 908;
  Gene Symbol: ALDOA;
  Gene Name: aldolase A, fructose-bisphosphate;
  Uniprot ID:  P04075;
  ENSP ID: ENSP00000455724

SEQ ID NO: 4008 - protein, 364 aa, Homo sapiens; identical to SEQ ID NO: 4000
  Payload ID: 908;
  Gene Symbol: ALDOA;
  Gene Name: aldolase A, fructose-bisphosphate;
  Uniprot ID:  P04075;
  ENSP ID: ENSP00000455800

SEQ ID NO: 4009 - protein, 361 aa, Homo sapiens
  Payload ID: 908;
  Gene Symbol: ALDOA;
  Gene Name: aldolase A, fructose-bisphosphate;
  ENSP ID: ENSP00000455857
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALVRIGRRWAGCLGGWDSEKSPSHSTPLPA

SEQ ID NO: 4010 - protein, 364 aa, Homo sapiens; identical to SEQ ID NO: 4000
  Payload ID: 908;
  Gene Symbol: ALDOA;
  Gene Name: aldolase A, fructose-bisphosphate;
  Uniprot ID:  P04075;
  ENSP ID: ENSP00000455917

SEQ ID NO: 4011 - protein, 162 aa, Homo sapiens
  Payload ID: 908;
  Gene Symbol: ALDOA;
  Gene Name: aldolase A, fructose-bisphosphate;
  ENSP ID: ENSP00000456020
MPYQYPALTPEQKKELSDIAHRIVAPGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLAR

SEQ ID NO: 4012 - protein, 130 aa, Homo sapiens
  Payload ID: 908;
  Gene Symbol: ALDOA;
  Gene Name: aldolase A, fructose-bisphosphate;
  ENSP ID: ENSP00000456098
  MOD_RES (1)..(1): Any amino acid
XPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 4013 - protein, 418 aa, Homo sapiens; identical to SEQ ID NO: 4002
  Payload ID: 908;
  Gene Symbol: ALDOA;
  Gene Name: aldolase A, fructose-bisphosphate;
  Uniprot ID:  P04075;
  ENSP ID: ENSP00000457468

SEQ ID NO: 4014 - protein, 204 aa, Homo sapiens
  Payload ID: 908;
  Gene Symbol: ALDOA;
  Gene Name: aldolase A, fructose-bisphosphate;
  ENSP ID: ENSP00000457514
RRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQVLAAVYKALSDHHIYLEGTLLKPNMVTPGHACTQKFSHEEIAMATVTALRRTVPPAVTGITFLSGGQSEEEASINLNAI

SEQ ID NO: 4015 - protein, 155 aa, Homo sapiens
  Payload ID: 908;
  Gene Symbol: ALDOA;
  Gene Name: aldolase A, fructose-bisphosphate;
  ENSP ID: ENSP00000457643
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIG

SEQ ID NO: 4016 - protein, 12 aa, Homo sapiens
  Payload ID: 908;
  Gene Symbol: ALDOA;
  Gene Name: aldolase A, fructose-bisphosphate;
  ENSP ID: ENSP00000457683
MPYQYPALTPEQ

SEQ ID NO: 4017 - protein, 368 aa, Homo sapiens; identical to SEQ ID NO: 4001
  Payload ID: 908;
  Gene Symbol: ALDOA;
  Gene Name: aldolase A, fructose-bisphosphate;
  ENSP ID: ENSP00000485952

SEQ ID NO: 4018 - protein, 364 aa, Homo sapiens
  Payload ID: 909;
  Gene Symbol: ALDOB;
  Gene Name: aldolase B, fructose-bisphosphate;
  Uniprot ID:  P05062;
  ENSP ID: ENSP00000363988
MAHRFPALTQEQKKELSEIAQSIVANGKGILAADESVGTMGNRLQRIKVENTEENRRQFREILFSVDSSINQSIGGVILFHETLYQKDSQGKLFRNILKEKGIVVGIKLDQGGAPLAGTNKETTIQGLDGLSERCAQYKKDGVDFGKWRAVLRIADQCPSSLAIQENANALARYASICQQNGLVPIVEPEVIPDGDHDLEHCQYVTEKVLAAVYKALNDHHVYLEGTLLKPNMVTAGHACTKKYTPEQVAMATVTALHRTVPAAVPGICFLSGGMSEEDATLNLNAINLCPLPKPWKLSFSYGRALQASALAAWGGKAANKEATQEAFMKRAMANCQAAKGQYVHTGSSGAASTQSLFTACYTY

SEQ ID NO: 4019 - protein, 316 aa, Homo sapiens [sequence omitted]

SEQ ID NO: 4020 - protein, 364 aa, Homo sapiens
  Payload ID: 910;
  Gene Symbol: ALDOC;
  Gene Name: aldolase C, fructose-bisphosphate;
  Uniprot ID:  P09972;
  ENSP ID: ENSP00000226253
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 4021 - protein, 336 aa, Homo sapiens
  Payload ID: 910;
  Gene Symbol: ALDOC;
  Gene Name: aldolase C, fructose-bisphosphate;
  ENSP ID: ENSP00000378729
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 4022 - protein, 364 aa, Homo sapiens; identical to SEQ ID NO: 4020
  Payload ID: 910;
  Gene Symbol: ALDOC;
  Gene Name: aldolase C, fructose-bisphosphate;
  Uniprot ID:  P09972;
  ENSP ID: ENSP00000378731

SEQ ID NO: 4023 - protein, 149 aa, Homo sapiens
  Payload ID: 910;
  Gene Symbol: ALDOC;
  Gene Name: aldolase C, fructose-bisphosphate;
  ENSP ID: ENSP00000398976
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWR

SEQ ID NO: 4024 - protein, 175 aa, Homo sapiens
  Payload ID: 910;
  Gene Symbol: ALDOC;
  Gene Name: aldolase C, fructose-bisphosphate;
  ENSP ID: ENSP00000462674
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYA

SEQ ID NO: 4025 - protein, 122 aa, Homo sapiens
  Payload ID: 910;
  Gene Symbol: ALDOC;
  Gene Name: aldolase C, fructose-bisphosphate;
  ENSP ID: ENSP00000463118
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGE

SEQ ID NO: 4026 - protein, 180 aa, Homo sapiens
  Payload ID: 910;
  Gene Symbol: ALDOC;
  Gene Name: aldolase C, fructose-bisphosphate;
  ENSP ID: ENSP00000463174
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQ

SEQ ID NO: 4027 - protein, 135 aa, Homo sapiens
  Payload ID: 910;
  Gene Symbol: ALDOC;
  Gene Name: aldolase C, fructose-bisphosphate;
  ENSP ID: ENSP00000465623
MAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARY

SEQ ID NO: 4028 - protein, 464 aa, Homo sapiens
  Payload ID: 911;
  Gene Symbol: ALG1;
  Gene Name: ALG1, chitobiosyldiphosphodolichol beta-mannosyltransferase;
  Uniprot ID:  Q9BT22;
  ENSP ID: ENSP00000262374
MAASCLVLLALCLLLPLLLLGGWKRWRRGRAARHVVAVVLGDVGRSPRMQYHALSLAMHGFSVTLLGFCNSKPHDELLQNNRIQIVGLTELQSLAVGPRVFQYGVKVVLQAMYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPALLVSSTSWTEDEDFSILLAALEKFEQLTLDGHNLPSLVCVITGKGPLREYYSRLIHQKHFQHIQVCTPWLEAEDYPLLLGSADLGVCLHTSSSGLDLPMKVVDMFGCCLPVCAVNFKCLHELVKHEENGLVFEDSEELAAQLQMLFSNFPDPAGKLNQFRKNLRESQQLRWDESWVQTVLPLVMDT

SEQ ID NO: 4029 - protein, 353 aa, Homo sapiens
  Payload ID: 911;
  Gene Symbol: ALG1;
  Gene Name: ALG1, chitobiosyldiphosphodolichol beta-mannosyltransferase;
  Uniprot ID:  Q9BT22;
  ENSP ID: ENSP00000440019
MYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPALLVSSTSWTEDEDFSILLAALEKFEQLTLDGHNLPSLVCVITGKGPLREYYSRLIHQKHFQHIQVCTPWLEAEDYPLLLGSADLGVCLHTSSSGLDLPMKVVDMFGCCLPVCAVNFKCLHELVKHEENGLVFEDSEELAAQLQMLFSNFPDPAGKLNQFRKNLRESQQLRWDESWVQTVLPLVMDT

SEQ ID NO: 4030 - protein, 167 aa, Homo sapiens
  Payload ID: 911;
  Gene Symbol: ALG1;
  Gene Name: ALG1, chitobiosyldiphosphodolichol beta-mannosyltransferase;
  ENSP ID: ENSP00000464700
MYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPA

SEQ ID NO: 4031 - protein, 184 aa, Homo sapiens
  Payload ID: 911;
  Gene Symbol: ALG1;
  Gene Name: ALG1, chitobiosyldiphosphodolichol beta-mannosyltransferase;
  ENSP ID: ENSP00000467538
MAASCLVLLALCLLLPLLLLGGWKRWRRGRAARHVVAVVLGDVGRSPRMQYHALSLAMHGFSVTLLGFCNSKPHDELLQNNRIQIVGLTELQSLAVGPRVFQYGVKVVLQAMYLLWKLMWREPGAYIFLQVCLALLSAGSWAAFVEASSSLTGTTMATPSWVWCMAPTIPSFCWPSGTRSSLGA

SEQ ID NO: 4032 - protein, 84 aa, Homo sapiens
  Payload ID: 911;
  Gene Symbol: ALG1;
  Gene Name: ALG1, chitobiosyldiphosphodolichol beta-mannosyltransferase;
  ENSP ID: ENSP00000467865
MAASCLVLLALCLLLPLLLLGGWKRWRRGRAARHVVAVVLGDVGRSPRMQYHALSLAMHGFSVTLLGFCSEWPRVWEGRCSLSR

SEQ ID NO: 4033 - protein, 353 aa, Homo sapiens; identical to SEQ ID NO: 4029
  Payload ID: 911;
  Gene Symbol: ALG1;
  Gene Name: ALG1, chitobiosyldiphosphodolichol beta-mannosyltransferase;
  Uniprot ID:  Q9BT22;
  ENSP ID: ENSP00000468118

SEQ ID NO: 4034 - protein, 187 aa, Homo sapiens
  Payload ID: 912;
  Gene Symbol: ALG1L;
  Gene Name: ALG1, chitobiosyldiphosphodolichol beta-mannosyltransferase-like;
  Uniprot ID:  Q6GMV1;
  ENSP ID: ENSP00000340009
MERSAFMELDAGSRLVMHLREWPALLVSSTGWTEFEQLTLDGHNLPSLVCVITGSVDLGVCLHMSSSGLDLPMKVVDMFGCCLPVCAVNFKCLHELVKHEENGLVFEDSEELAALQMLFSNFPDPAGKLNQFWKNLRESQQLRWDESWVQTVLPLVMDIQLLGQRLKPRDPCCPSRSFFSESQGKPF

SEQ ID NO: 4035 - protein, 207 aa, Homo sapiens
  Payload ID: 912;
  Gene Symbol: ALG1L;
  Gene Name: ALG1, chitobiosyldiphosphodolichol beta-mannosyltransferase-like;
  ENSP ID: ENSP00000482705
MKLGGTHSLFRACSEPEDAAMERSAFMELDAGSRLVMHLREWPALLVSSTGWTEFEQLTLDGHNLPSLVCVITGSVDLGVCLHMSSSGLDLPMKVVDMFGCCLPVCAVNFKCLHELVKHEENGLVFEDSEELAALQMLFSNFPDPAGKLNQFWKNLRESQQLRWDESWVQTVLPLVMDIQLLGQRLKPRDPCCPSRSFFSESQGKPF

SEQ ID NO: 4036 - protein, 215 aa, Homo sapiens
  Payload ID: 913;
  Gene Symbol: ALG1L2;
  Gene Name: ALG1, chitobiosyldiphosphodolichol beta-mannosyltransferase-like 2;
  Uniprot ID:  C9J202;
  ENSP ID: ENSP00000479850
MGATAGWAVTVYDKPASFFKEAPLDLQHRLFMKLGSTHSPFRARSEPEDPDTERSAFTERDSGSGLVTRLHERPALLVSSTSWTEFEQLTLDGQNLPSLVCVITGKGPLREYYSRLIHQKHFQHIQVCIPWLEGRGLPPLLGSVDLDVCLDTSSSGLDLPMKVVDMFRCCLPACAVNFKCLHELVKHEENRLVFEDSEELAAQLQYFADAFLKLS

SEQ ID NO: 4037 - protein, 473 aa, Homo sapiens
  Payload ID: 914;
  Gene Symbol: ALG10;
  Gene Name: ALG10, alpha-1,2-glucosyltransferase;
  Uniprot ID:  Q5BKT4;
  ENSP ID: ENSP00000266483
MAQLEGYYFSAALSCTFLVSCLLFSAFSRALREPYMDEIFHLPQAQRYCEGHFSLSQWDPMITTLPGLYLVSIGVIKPAIWIFGWSEHVVCSIGMLRFVNLLFSVGNFYLLYLLFCKVQPRNKAASSIQRVLSTLTLAVFPTLYFFNFLYYTEAGSMFFTLFAYLMCLYGNHKTSAFLGFCGFMFRQTNIIWAVFCAGNVIAQKLTEAWKTELQKKEDRLPPIKGPFAEFRKILQFLLAYSMSFKNLSMLLLLTWPYILLGFLFCAFVVVNGGIVIGDRSSHEACLHFPQLFYFFSFTLFFSFPHLLSPSKIKTFLSLVWKRRILFFVVTLVSVFLVWKFTYAHKYLLADNRHYTFYVWKRVFQRYETVKYLLVPAYIFAGWSIADSLKSKSIFWNLMFFICLFTVIVPQKLLEFRYFILPYVIYRLNIPLPPTSRLICELSCYAVVNFITFFIFLNKTFQWPNSQDIQRFMW

SEQ ID NO: 4038 - protein, 77 aa, Homo sapiens
  Payload ID: 914;
  Gene Symbol: ALG10;
  Gene Name: ALG10, alpha-1,2-glucosyltransferase;
  ENSP ID: ENSP00000443142
MAQLEGYYFSAALSCTFLVSCLLFSAFSRALREPYMDEIFHLPQAQRYLGSHDYYITWLVPGVNWSDQTCHLDLWMV

SEQ ID NO: 4039 - protein, 126 aa, Homo sapiens
  Payload ID: 914;
  Gene Symbol: ALG10;
  Gene Name: ALG10, alpha-1,2-glucosyltransferase;
  ENSP ID: ENSP00000444084
MAQLEGYYFSAALSCTFLVSCLLFSAFSRALREPYMDEIFHLPQAQRYCEGHFSLSQWDPMITTLPGLYLVSIGVIKPAIWIFGWSEHVVCSIGMLRFVNLLFSVGNFYLLYLLFCKVQPRNKEYF

SEQ ID NO: 4040 - protein, 473 aa, Homo sapiens
  Payload ID: 915;
  Gene Symbol: ALG10B;
  Gene Name: ALG10B, alpha-1,2-glucosyltransferase;
  Uniprot ID:  Q5I7T1;
  ENSP ID: ENSP00000310120
MAQLEGYCFSAALSCTFLVSCLLFSAFSRALREPYMDEIFHLPQAQRYCEGHFSLSQWDPMITTLPGLYLVSVGVVKPAIWIFAWSEHVVCSIGMLRFVNLLFSVGNFYLLYLLFHKVQPRNKAASSIQRVLSTLTLAVFPTLYFFNFLYYTEAGSMFFTLFAYLMCLYGNHKTSAFLGFCGFMFRQTNIIWAVFCAGNVIAQKLTEAWKTELQKKEDRLPPIKGPFAEFRKILQFLLAYSMSFKNLSMLFCLTWPYILLGFLFCAFVVVNGGIVIGDRSSHEACLHFPQLFYFFSFTLFFSFPHLLSPSKIKTFLSLVWKHGILFLVVTLVSVFLVWKFTYAHKYLLADNRHYTFYVWKRVFQRYAILKYLLVPAYIFAGWSIADSLKSKPIFWNLMFFICLFIVIVPQKLLEFRYFILPYVIYRLNITLPPTSRLVCELSCYAIVNFITFYIFLNKTFQWPNSQDIQRFMW

SEQ ID NO: 4041 - protein, 126 aa, Homo sapiens
  Payload ID: 915;
  Gene Symbol: ALG10B;
  Gene Name: ALG10B, alpha-1,2-glucosyltransferase;
  ENSP ID: ENSP00000448819
MAQLEGYCFSAALSCTFLVSCLLFSAFSRALREPYMDEIFHLPQAQRYCEGHFSLSQWDPMITTLPGLYLVSVGVVKPAIWIFAWSEHVVCSIGMLRFVNLLFSVGNFYLLYLLFHKVQPRNKEYF

SEQ ID NO: 4042 - protein, 77 aa, Homo sapiens
  Payload ID: 915;
  Gene Symbol: ALG10B;
  Gene Name: ALG10B, alpha-1,2-glucosyltransferase;
  ENSP ID: ENSP00000449210
MAQLEGYCFSAALSCTFLVSCLLFSAFSRALREPYMDEIFHLPQAQRYLGSHDYYITWLVPGVSWSGQTCHLDLCMV

SEQ ID NO: 4043 - protein, 36 aa, Homo sapiens
  Payload ID: 916;
  Gene Symbol: ALG11;
  Gene Name: ALG11, alpha-1,2-mannosyltransferase;
  ENSP ID: ENSP00000429497
MAAGERSWCLCKLLRSCGVYGSWHNYPCTQFGGPKA

SEQ ID NO: 4044 - protein, 492 aa, Homo sapiens
  Payload ID: 916;
  Gene Symbol: ALG11;
  Gene Name: ALG11, alpha-1,2-mannosyltransferase;
  Uniprot ID:  Q2TAA5;
  ENSP ID: ENSP00000430236
MAAGERSWCLCKLLRFFYSLFFPGLIVCGTLCVCLVIVLWGIRLLLQRKKKLVSTSKNGKNQMVIAFFHPYCNAGGGGERVLWCALRALQKKYPEAVYVVYTGDVNVNGQQILEGAFRRFNIRLIHPVQFVFLRKRYLVEDSLYPHFTLLGQSLGSIFLGWEALMQCVPDVYIDSMGYAFTLPLFKYIGGCQVGSYVHYPTISTDMLSVVKNQNIGFNNAAFITRNPFLSKVKLIYYYLFAFIYGLVGSCSDVVMVNSSWTLNHILSLWKVGNCTNIVYPPCDVQTFLDIPLHEKKMTPGHLLVSVGQFRPEKNHPLQIRAFAKLLNKKMVESPPSLKLVLIGGCRNKDDELRVNQLRRLSEDLGVQEYVEFKINIPFDELKNYLSEATIGLHTMWNEHFGIGVVECMAAGTIILAHNSGGPKLDIVVPHEGDITGFLAESEEDYAETIAHILSMSAEKRLQIRKSARASVSRFSDQEFEVTFLSSVEKLFK

SEQ ID NO: 4045 - protein, 30 aa, Homo sapiens
  Payload ID: 916;
  Gene Symbol: ALG11;
  Gene Name: ALG11, alpha-1,2-mannosyltransferase;
  ENSP ID: ENSP00000481922
MAAGERSWCLCKLLSFEYVFISSVKMNLVP

SEQ ID NO: 4046 - protein, 488 aa, Homo sapiens
  Payload ID: 917;
  Gene Symbol: ALG12;
  Gene Name: ALG12, alpha-1,6-mannosyltransferase;
  Uniprot ID:  Q9BV10;
  ENSP ID: ENSP00000333813
MAGKGSSGRRPLLLGLLVAVATVHLVICPYTKVEESFNLQATHDLLYHWQDLEQYDHLEFPGVVPRTFLGPVVIAVFSSPAVYVLSLLEMSKFYSQLIVRGVLGLGVIFGLWTLQKEVRRHFGAMVATMFCWVTAMQFHLMFYCTRTLPNVLALPVVLLALAAWLRHEWARFIWLSAFAIIVFRVELCLFLGLLLLLALGNRKVSVVRALRHAVPAGILCLGLTVAVDSYFWRQLTWPEGKVLWYNTVLNKSSNWGTSPLLWYFYSALPRGLGCSLLFIPLGLVDRRTHAPTVLALGFMALYSLLPHKELRFIIYAFPMLNITAARGCSYLLNNYKKSWLYKAGSLLVIGHLVVNAAYSATALYVSHFNYPGGVAMQRLHQLVPPQTDVLLHIDVAAAQTGVSRFLQVNSAWRYDKREDVQPGTGMLAYTHILMEAAPGLLALYRDTHRVLASVVGTTGVSLNLTQLPPFNVHLQTKLVLLERLPRPS

SEQ ID NO: 4047 - protein, 196 aa, Homo sapiens
  Payload ID: 917;
  Gene Symbol: ALG12;
  Gene Name: ALG12, alpha-1,6-mannosyltransferase;
  ENSP ID: ENSP00000417387
  MOD_RES (1)..(1): Any amino acid
XLLALAAWLRHEWARFIWLSAFAIIVFRVELCLFLGLLLLLALGNRKVSVVRALRHAVPAGILCLGLTVAVDSYFWRQLTWPEGKVLWYNTVLNKSSNWGTSPLLWYFYSALPRGLGCSLLFIPLGLVDRRTHAPTVLALGFMALYSLLPHKELRFIIYAFPMLNITAARGCSYLWRRNAEAAPAGAPPDRRPSAH

SEQ ID NO: 4048 - protein, 205 aa, Homo sapiens
  Payload ID: 917;
  Gene Symbol: ALG12;
  Gene Name: ALG12, alpha-1,6-mannosyltransferase;
  ENSP ID: ENSP00000420630
  MOD_RES (1)..(1): Any amino acid
XSALPRGLGCSLLFIPLGLVDRRTHAPTVLALGFMALYSLLPHKELRFIIYAFPMLNITAARGCSYLLNNYKKSWLYKAGSLLVIGHLVVNAAYSATALYVSHFNYPGGVAMQRLHQLVPPQTDVLLHIDVAAAQTGVSRFLQVNSAWRQSWCFWRGSPGRPEGDQAALSSHRPSRSCYHYQFLAQFQHNYDNSEKQVKGLGTCL

SEQ ID NO: 4049 - protein, 954 aa, Homo sapiens
  Payload ID: 918;
  Gene Symbol: ALG13;
  Gene Name: ALG13, UDP-N-acetylglucosaminyltransferase subunit;
  Uniprot ID:  Q9NP73;
  ENSP ID: ENSP00000251943
MNNHQLELAKQLHKEGHLFYCTCRVLTCPGQAKSIASAPGKCQDSAALTSTAFSGLDFGLLSGYLHKQALVTATHPTCTLLFPSCHAFFPLPLTPTLYKMHKGWKNYCSQKSLNEASMDEYLGSLGLFRKLTAKDASCLFRAISEQLFCSQVHHLEIRKACVSYMRENQQTFESYVEGSFEKYLERLGDPKESAGQLEIRALSLIYNRDFILYRFPGKPPTYVTDNGYEDKILLCYSSSGHYDSVYSKQFQSSAAVCQAVLYEILYKDVFVVDEEELKTAIKLFRSGSKKNRNNAVTGSEDAHTDYKSSNQNRMEEWGACYNAENIPEGYNKGTEETKSPENPSKMPFPYKVLKALDPEIYRNVEFDVWLDSRKELQKSDYMEYAGRQYYLGDKCQVCLESEGRYYNAHIQEVGNENNSVTVFIEELAEKHVVPLANLKPVTQVMSVPAWNAMPSRKGRGYQKMPGGYVPEIVISEMDIKQQKKMFKKIRGKEVYMTMAYGKGDPLLPPRLQHSMHYGHDPPMHYSQTAGNVMSNEHFHPQHPSPRQGRGYGMPRNSSRFINRHNMPGPKVDFYPGPGKRCCQSYDNFSYRSRSFRRSHRQMSCVNKESQYGFTPGNGQMPRGLEETITFYEVEEGDETAYPTLPNHGGPSTMVPATSGYCVGRRGHSSGKQTLNLEEGNGQSENGRYHEEYLYRAEPDYETSGVYSTTASTANLSLQDRKSCSMSPQDTVTSYNYPQKMMGNIAAVAASCANNVPAPVLSNGAAANQAISTTSVSSQNAIQPLFVSPPTHGRPDTKVLQYYFNLGLQCYYHSYWHSMVYVPQMQQQLHVENYPVYTEPPLVDQTVPQCYSEVRREDGIQAEASANDTFPNADSSSVPHGAVYYPVMSDPYGQPPLPGFDSCLPVVPDYSCVPPWHPVGTAYGGSSQIHGAINPGPIGCIAPSPPASHYVPQGM

SEQ ID NO: 4050 - protein, 165 aa, Homo sapiens
  Payload ID: 918;
  Gene Symbol: ALG13;
  Gene Name: ALG13, UDP-N-acetylglucosaminyltransferase subunit;
  Uniprot ID:  Q9NP73;
  ENSP ID: ENSP00000361047
MKCVFVTVGTTSFDDLIACVSAPDSLQKIESLGYNRLILQIGRGTVVPEPFSTESFTLDVYRYKDSLKEDIQKADLVISHAGAGSCLETLEKGKPLVVVINEKLMNNHQLELAKQLHKEGHLFYCTCSTLPGLLQSMDLSTLKCYPPGQPEKFSAFLDKVVGLQK

SEQ ID NO: 4051 - protein, 1137 aa, Homo sapiens
  Payload ID: 918;
  Gene Symbol: ALG13;
  Gene Name: ALG13, UDP-N-acetylglucosaminyltransferase subunit;
  Uniprot ID:  Q9NP73;
  ENSP ID: ENSP00000378260
MKCVFVTVGTTSFDDLIACVSAPDSLQKIESLGYNRLILQIGRGTVVPEPFSTESFTLDVYRYKDSLKEDIQKADLVISHAGAGSCLETLEKGKPLVVVINEKLMNNHQLELAKQLHKEGHLFYCTCRVLTCPGQAKSIASAPGKCQDSAALTSTAFSGLDFGLLSGYLHKQALVTATHPTCTLLFPSCHAFFPLPLTPTLYKMHKGWKNYCSQKSLNEASMDEYLGSLGLFRKLTAKDASCLFRAISEQLFCSQVHHLEIRKACVSYMRENQQTFESYVEGSFEKYLERLGDPKESAGQLEIRALSLIYNRDFILYRFPGKPPTYVTDNGYEDKILLCYSSSGHYDSVYSKQFQSSAAVCQAVLYEILYKDVFVVDEEELKTAIKLFRSGSKKNRNNAVTGSEDAHTDYKSSNQNRMEEWGACYNAENIPEGYNKGTEETKSPENPSKMPFPYKVLKALDPEIYRNVEFDVWLDSRKELQKSDYMEYAGRQYYLGDKCQVCLESEGRYYNAHIQEVGNENNSVTVFIEELAEKHVVPLANLKPVTQVMSVPAWNAMPSRKGRGYQKMPGGYVPEIVISEMDIKQQKKMFKKIRGKEVYMTMAYGKGDPLLPPRLQHSMHYGHDPPMHYSQTAGNVMSNEHFHPQHPSPRQGRGYGMPRNSSRFINRHNMPGPKVDFYPGPGKRCCQSYDNFSYRSRSFRRSHRQMSCVNKESQYGFTPGNGQMPRGLEETITFYEVEEGDETAYPTLPNHGGPSTMVPATSGYCVGRRGHSSGKQTLNLEEGNGQSENGRYHEEYLYRAEPDYETSGVYSTTASTANLSLQDRKSCSMSPQDTVTSYNYPQKMMGNIAAVAASCANNVPAPVLSNGAAANQAISTTSVSSQNAIQPLFVSPPTHGRPVIASPSYPCHSAIPHAGASLPPPPPPPPPPPPPPPPPPPPPPPPPPPALDVGETSNLQPPPPLPPPPYSCDPSGSDLPQDTKVLQYYFNLGLQCYYHSYWHSMVYVPQMQQQLHVENYPVYTEPPLVDQTVPQCYSEVRREDGIQAEASANDTFPNADSSSVPHGAVYYPVMSDPYGQPPLPGFDSCLPVVPDYSCVPPWHPVGTAYGGSSQIHGAINPGPIGCIAPSPPASHYVPQGM

SEQ ID NO: 4052 - protein, 954 aa, Homo sapiens; identical to SEQ ID NO: 4049
  Payload ID: 918;
  Gene Symbol: ALG13;
  Gene Name: ALG13, UDP-N-acetylglucosaminyltransferase subunit;
  Uniprot ID:  Q9NP73;
  ENSP ID: ENSP00000392990

SEQ ID NO: 4053 - protein, 159 aa, Homo sapiens
  Payload ID: 918;
  Gene Symbol: ALG13;
  Gene Name: ALG13, UDP-N-acetylglucosaminyltransferase subunit;
  ENSP ID: ENSP00000426892
MKCVFVTVGTTSFDDLIACVSAPDSLQKIESLGYNRLILQIGRGTVVPEPFSTESFTLDVYRYKDSLKEDIQKADLVISHAGAGSCLETLEKGKPLVVVINEKLMNNHQLELAKQLHKEGHLFYCTCRLILKKCLLVVEGGDKEILWVAGGSQLGLKFC

SEQ ID NO: 4054 - protein, 51 aa, Homo sapiens
  Payload ID: 918;
  Gene Symbol: ALG13;
  Gene Name: ALG13, UDP-N-acetylglucosaminyltransferase subunit;
  ENSP ID: ENSP00000427093
MKCVFVTVGTTSFDDLIACVSAPDSLQVSEGGEQAAAWLATRHLRPYCQPR

SEQ ID NO: 4055 - protein, 61 aa, Homo sapiens
  Payload ID: 918;
  Gene Symbol: ALG13;
  Gene Name: ALG13, UDP-N-acetylglucosaminyltransferase subunit;
  ENSP ID: ENSP00000477513
MNNHQLELAKQLHKEGHLFYCTCSTLPGLLQSMDLSTLKCYPPGQPEKFSAFLDKVVGLQK

SEQ ID NO: 4056 - protein, 171 aa, Homo sapiens
  Payload ID: 918;
  Gene Symbol: ALG13;
  Gene Name: ALG13, UDP-N-acetylglucosaminyltransferase subunit;
  ENSP ID: ENSP00000478130
MLDTSCLQTSDSKFFSFGTRTGSPCSSACRHPIVGPCDCKIESLGYNRLILQIGRGTVVPEPFSTESFTLDVYRYKDSLKEDIQKADLVISHAGAGSCLETLEKGKPLVVVINEKLMNNHQLELAKQLHKEGHLFYCTCRLILKKCLLVVEGGDKEILWVAGGSQLGLKFC

SEQ ID NO: 4057 - protein, 43 aa, Homo sapiens
  Payload ID: 918;
  Gene Symbol: ALG13;
  Gene Name: ALG13, UDP-N-acetylglucosaminyltransferase subunit;
  ENSP ID: ENSP00000479424
MKCVFVTVGTTSFDDLIACVSAPDSLQVQGFLERRHSESRSCY

SEQ ID NO: 4058 - protein, 43 aa, Homo sapiens; identical to SEQ ID NO: 4057
  Payload ID: 918;
  Gene Symbol: ALG13;
  Gene Name: ALG13, UDP-N-acetylglucosaminyltransferase subunit;
  ENSP ID: ENSP00000479483

SEQ ID NO: 4059 - protein, 51 aa, Homo sapiens; identical to SEQ ID NO: 4054
  Payload ID: 918;
  Gene Symbol: ALG13;
  Gene Name: ALG13, UDP-N-acetylglucosaminyltransferase subunit;
  ENSP ID: ENSP00000479632

SEQ ID NO: 4060 - protein, 1059 aa, Homo sapiens
  Payload ID: 918;
  Gene Symbol: ALG13;
  Gene Name: ALG13, UDP-N-acetylglucosaminyltransferase subunit;
  Uniprot ID:  Q9NP73;
  ENSP ID: ENSP00000479731
MFTGAGSCLETLEKGKPLVVVINEKLMNNHQLELAKQLHKEGHLFYCTCRVLTCPGQAKSIASAPGKCQDSAALTSTAFSGLDFGLLSGYLHKQALVTATHPTCTLLFPSCHAFFPLPLTPTLYKMHKGWKNYCSQKSLNEASMDEYLGSLGLFRKLTAKDASCLFRAISEQLFCSQVHHLEIRKACVSYMRENQQTFESYVEGSFEKYLERLGDPKESAGQLEIRALSLIYNRDFILYRFPGKPPTYVTDNGYEDKILLCYSSSGHYDSVYSKQFQSSAAVCQAVLYEILYKDVFVVDEEELKTAIKLFRSGSKKNRNNAVTGSEDAHTDYKSSNQNRMEEWGACYNAENIPEGYNKGTEETKSPENPSKMPFPYKVLKALDPEIYRNVEFDVWLDSRKELQKSDYMEYAGRQYYLGDKCQVCLESEGRYYNAHIQEVGNENNSVTVFIEELAEKHVVPLANLKPVTQVMSVPAWNAMPSRKGRGYQKMPGGYVPEIVISEMDIKQQKKMFKKIRGKEVYMTMAYGKGDPLLPPRLQHSMHYGHDPPMHYSQTAGNVMSNEHFHPQHPSPRQGRGYGMPRNSSRFINRHNMPGPKVDFYPGPGKRCCQSYDNFSYRSRSFRRSHRQMSCVNKESQYGFTPGNGQMPRGLEETITFYEVEEGDETAYPTLPNHGGPSTMVPATSGYCVGRRGHSSGKQTLNLEEGNGQSENGRYHEEYLYRAEPDYETSGVYSTTASTANLSLQDRKSCSMSPQDTVTSYNYPQKMMGNIAAVAASCANNVPAPVLSNGAAANQAISTTSVSSQNAIQPLFVSPPTHGRPVIASPSYPCHSAIPHAGASLPPPPPPPPPPPPPPPPPPPPPPPPPPPALDVGETSNLQPPPPLPPPPYSCDPSGSDLPQDTKVLQYYFNLGLQCYYHSYWHSMVYVPQMQQQLHVENYPVYTEPPLVDQTVPQCYSEVRREDGIQAEASANDTFPNADSSSVPHGAVYYPVMSDPYGQPPLPGFDSCLPVVPDYSCVPPWHPVGTAYGGSSQIHGAINPGPIGCIAPSPPASHYVPQGM

SEQ ID NO: 4061 - protein, 51 aa, Homo sapiens; identical to SEQ ID NO: 4054
  Payload ID: 918;
  Gene Symbol: ALG13;
  Gene Name: ALG13, UDP-N-acetylglucosaminyltransferase subunit;
  ENSP ID: ENSP00000480638

SEQ ID NO: 4062 - protein, 133 aa, Homo sapiens
  Payload ID: 918;
  Gene Symbol: ALG13;
  Gene Name: ALG13, UDP-N-acetylglucosaminyltransferase subunit;
  ENSP ID: ENSP00000480711
MKCVFVTVGTTSFDDLIACVSAPDSLQKIESLGYNRLILQIGRGTVVPEPFSTESFTLDVYRYKDSLKEDIQKADLVISHAGAGSCLETLEKGKPLVVVINEKLMNNHQLELAKQLHKEGHLFYCTCSSSLRH

SEQ ID NO: 4063 - protein, 954 aa, Homo sapiens; identical to SEQ ID NO: 4049
  Payload ID: 918;
  Gene Symbol: ALG13;
  Gene Name: ALG13, UDP-N-acetylglucosaminyltransferase subunit;
  Uniprot ID:  Q9NP73;
  ENSP ID: ENSP00000481509

SEQ ID NO: 4064 - protein, 51 aa, Homo sapiens; identical to SEQ ID NO: 4054
  Payload ID: 918;
  Gene Symbol: ALG13;
  Gene Name: ALG13, UDP-N-acetylglucosaminyltransferase subunit;
  ENSP ID: ENSP00000482257

SEQ ID NO: 4065 - protein, 35 aa, Homo sapiens
  Payload ID: 918;
  Gene Symbol: ALG13;
  Gene Name: ALG13, UDP-N-acetylglucosaminyltransferase subunit;
  ENSP ID: ENSP00000484523
IACVSAPDSLQVSEGGEQAAAWLATRHLRPYCQPR

SEQ ID NO: 4066 - protein, 132 aa, Homo sapiens
  Payload ID: 918;
  Gene Symbol: ALG13;
  Gene Name: ALG13, UDP-N-acetylglucosaminyltransferase subunit;
  ENSP ID: ENSP00000485067
MKCVFVTVGTTSFDDLIACVSAPDSLQKIESLGYNRLILQIGRGTVVPEPFSTESFTLDVYRYKDSLKEDIQKADLVISHAGAGSCLETLEKGKPLVVVINEKLMNNHQLELAKQLHKEGHLFYCTCRYARD

SEQ ID NO: 4067 - protein, 77 aa, Homo sapiens
  Payload ID: 918;
  Gene Symbol: ALG13;
  Gene Name: ALG13, UDP-N-acetylglucosaminyltransferase subunit;
  ENSP ID: ENSP00000485071
  MOD_RES (1)..(1): Any amino acid
XPPLPGFDSCLPVVPDYSCVPPWHPVGTAYGGSSQIHGAINPGPIGCIAPSPPASHYVPQESKTKSLCFWITHLILN

SEQ ID NO: 4068 - protein, 150 aa, Homo sapiens
  Payload ID: 918;
  Gene Symbol: ALG13;
  Gene Name: ALG13, UDP-N-acetylglucosaminyltransferase subunit;
  ENSP ID: ENSP00000485093
MKCVFVTVGTTSFDDLIACVSAPDSLQKIESLGYNRLILQIGRGTVVPEPFSTESFTLDVYRCRKLFGDSGKRKATRSGYKRKVDEQSSAGTGKAATQRGSSLLLYLQGPDLSWASQVHCFCSWEVPRFCSADFNCLFRPRLWAAFRIPA

SEQ ID NO: 4069 - protein, 43 aa, Homo sapiens; identical to SEQ ID NO: 4057
  Payload ID: 918;
  Gene Symbol: ALG13;
  Gene Name: ALG13, UDP-N-acetylglucosaminyltransferase subunit;
  ENSP ID: ENSP00000485181

SEQ ID NO: 4070 - protein, 51 aa, Homo sapiens; identical to SEQ ID NO: 4054
  Payload ID: 918;
  Gene Symbol: ALG13;
  Gene Name: ALG13, UDP-N-acetylglucosaminyltransferase subunit;
  ENSP ID: ENSP00000485279

SEQ ID NO: 4071 - protein, 162 aa, Homo sapiens
  Payload ID: 918;
  Gene Symbol: ALG13;
  Gene Name: ALG13, UDP-N-acetylglucosaminyltransferase subunit;
  ENSP ID: ENSP00000485333
VTVGTTSFDDLIACVSAPDSLQKIESLGYNRLILQIGRGTVVPEPFSTESFTLDVYRYKDSLKEDIQKADLVISHAGKGAGSCLETLEKGKPLVVVINEKLMNNHQLELAKQLHKEGHLFYCTCSTLPGLLQSMDLSTLKCYPPGQPEKFSAFLDKVVGLQK

SEQ ID NO: 4072 - protein, 61 aa, Homo sapiens; identical to SEQ ID NO: 4055
  Payload ID: 918;
  Gene Symbol: ALG13;
  Gene Name: ALG13, UDP-N-acetylglucosaminyltransferase subunit;
  ENSP ID: ENSP00000485392

SEQ ID NO: 4073 - protein, 42 aa, Homo sapiens
  Payload ID: 918;
  Gene Symbol: ALG13;
  Gene Name: ALG13, UDP-N-acetylglucosaminyltransferase subunit;
  ENSP ID: ENSP00000485400
  MOD_RES (1)..(1): Any amino acid
XPPLPPPPYSCDPSGSDLPQDTKVLQYYFNLGLQVSAMLKFL

SEQ ID NO: 4074 - protein, 51 aa, Homo sapiens; identical to SEQ ID NO: 4054
  Payload ID: 918;
  Gene Symbol: ALG13;
  Gene Name: ALG13, UDP-N-acetylglucosaminyltransferase subunit;
  ENSP ID: ENSP00000485420

SEQ ID NO: 4075 - protein, 373 aa, Homo sapiens
  Payload ID: 918;
  Gene Symbol: ALG13;
  Gene Name: ALG13, UDP-N-acetylglucosaminyltransferase subunit;
  ENSP ID: ENSP00000485624
DSVYSKQFQSSAAVCQAVLYEILYKDVFVVDEEELKTAIKLFRSGSKKNRNNAVTGSEDAHTDYKSSNQNRMEEWGACYNAENIPEGYNKGTEETKVCLESEGRYYNAHIQEVGNENNSVTVFIEELAEKHVVPLANLKPVTQVMSVPAWNAMPSRKGRGYQKMPGGYVPEIVISEMDIKQQKKMFKKIRGKEVYMTMAYGKGDPLLPPRLQHSMHYGHDPPMHYSQTAGNVMSNEHFHPQHPSPRQGRGYGMPRNSSRFINRHNMPGPKVDFYPGPGKRCCQSYDNFSYRSRSFRRSHRQMSCVNKESQYGFTPGNGQMPRGLEETITFYEVEEGDETAYPTLPNHGGPSTMVPATSGYCVGRRGHSSGKQT

SEQ ID NO: 4076 - protein, 35 aa, Homo sapiens; identical to SEQ ID NO: 4065
  Payload ID: 918;
  Gene Symbol: ALG13;
  Gene Name: ALG13, UDP-N-acetylglucosaminyltransferase subunit;
  ENSP ID: ENSP00000485658

SEQ ID NO: 4077 - protein, 216 aa, Homo sapiens
  Payload ID: 919;
  Gene Symbol: ALG14;
  Gene Name: ALG14, UDP-N-acetylglucosaminyltransferase subunit;
  Uniprot ID:  Q96F25;
  ENSP ID: ENSP00000359224
MVCVLVLAAAAGAVAVFLILRIWVVLRSMDVTPRESLSILVVAGSGGHTTEILRLLGSLSNAYSPRHYVIADTDEMSANKINSFELDRADRDPSNMYTKYYIHRIPRSREVQQSWPSTVFTTLHSMWLSFPLIHRVKPDLVLCNGPGTCVPICVSALLLGILGIKKVIIVYVESICRVETLSMSGKILFHLSDYFIVQWPALKEKYPKSVYLGRIV

SEQ ID NO: 4078 - protein, 323 aa, Homo sapiens
  Payload ID: 920;
  Gene Symbol: ALG2;
  Gene Name: ALG2, alpha-1,3/1,6-mannosyltransferase;
  Uniprot ID:  Q9H553;
  ENSP ID: ENSP00000326609
MPLLKLVHGSPLVFGEKFKLFTLVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 4079 - protein, 416 aa, Homo sapiens
  Payload ID: 920;
  Gene Symbol: ALG2;
  Gene Name: ALG2, alpha-1,3/1,6-mannosyltransferase;
  Uniprot ID:  Q9H553;
  ENSP ID: ENSP00000417764
MAEEQGRERDSVPKPSVLFLHPDLGVGGAERLVLDAALALQARGCSVKIWTAHYDPGHCFAESRELPVRCAGDWLPRGLGWGGRGAAVCAYVRMVFLALYVLFLADEEFDVVVCDQVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 4080 - protein, 138 aa, Homo sapiens
  Payload ID: 920;
  Gene Symbol: ALG2;
  Gene Name: ALG2, alpha-1,3/1,6-mannosyltransferase;
  ENSP ID: ENSP00000432675
MAEEQGRERDSVPKPSVLFLHPDLGVGGAERLVLDAALALQARGCSVKIWTAHYDPGHCFAESRELPVRCAGDWLPRGLGWGGRGAAVCAYVRMVFLALYVLFLADEEFDVVVCDQAICIPLSLCSEPGHTVLSSVMC

SEQ ID NO: 4081 - protein, 438 aa, Homo sapiens
  Payload ID: 921;
  Gene Symbol: ALG3;
  Gene Name: ALG3, alpha-1,3- mannosyltransferase;
  Uniprot ID:  Q92685;
  ENSP ID: ENSP00000380793
MAAGLRKRGRSGSAAQAEGLCKQWLQRAWQERRLLLREPRYTLLVAACLCLAEVGITFWVIHRVAYTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 4082 - protein, 105 aa, Homo sapiens
  Payload ID: 921;
  Gene Symbol: ALG3;
  Gene Name: ALG3, alpha-1,3- mannosyltransferase;
  ENSP ID: ENSP00000392209
  MOD_RES (1)..(1): Any amino acid
XGLRKRGRSGSAAQAEGLCKQWLQRAWQERRLLLREPRYTLLVAACLCLAEVGITFWVIHRVACTQLVSCTSLWGCTMPPAEALTSAWPRTSLLCSTWLPCCLSS

SEQ ID NO: 4083 - protein, 107 aa, Homo sapiens
  Payload ID: 921;
  Gene Symbol: ALG3;
  Gene Name: ALG3, alpha-1,3- mannosyltransferase;
  ENSP ID: ENSP00000394917
MAAGLRKRGRSGSAAQAEGLCKQWLQRAWQERRLLLREPRYTLLVAACLCLAEVGITFWVIHRVACTQLVSCTSLWGCTMPPAEALTSAWPRTSLLCSTWLPCCLSS

SEQ ID NO: 4084 - protein, 323 aa, Homo sapiens
  Payload ID: 921;
  Gene Symbol: ALG3;
  Gene Name: ALG3, alpha-1,3- mannosyltransferase;
  ENSP ID: ENSP00000397326
  MOD_RES (1)..(1): Any amino acid
XAGLRKRGRSGSAAQAEGLCKQWLQRAWQERRLLLREPRYTLLVAACLCLAEVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQ

SEQ ID NO: 4085 - protein, 398 aa, Homo sapiens
  Payload ID: 921;
  Gene Symbol: ALG3;
  Gene Name: ALG3, alpha-1,3- mannosyltransferase;
  ENSP ID: ENSP00000397613
MKTGYSDRRLAWWDARHGKRNLSVEDTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 4086 - protein, 390 aa, Homo sapiens
  Payload ID: 921;
  Gene Symbol: ALG3;
  Gene Name: ALG3, alpha-1,3- mannosyltransferase;
  Uniprot ID:  Q92685;
  ENSP ID: ENSP00000402744
MFPAQAKENAGFSGCGGDTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 4087 - protein, 65 aa, Homo sapiens
  Payload ID: 921;
  Gene Symbol: ALG3;
  Gene Name: ALG3, alpha-1,3- mannosyltransferase;
  ENSP ID: ENSP00000407011
MAAGLRKRGRSGSAAQAEGLCKQWLQRAWQERRLLLREPRYTLLVAACLCLAETQRLTGRPTWPR

SEQ ID NO: 4088 - protein, 324 aa, Homo sapiens
  Payload ID: 922;
  Gene Symbol: ALG5;
  Gene Name: ALG5, dolichyl-phosphate beta-glucosyltransferase;
  Uniprot ID:  Q9Y673;
  ENSP ID: ENSP00000239891
MAPLLLQLAVLGAALAAAALVLISIVAFTTATKMPALHRHEEEKFFLNAKGQKETLPSIWDSPTKQLSVVVPSYNEEKRLPVMMDEALSYLEKRQKRDPAFTYEVIVVDDGSKDQTSKVAFKYCQKYGSDKVRVITLVKNRGKGGAIRMGIFSSRGEKILMADADGATKFPDVEKLEKGLNDLQPWPNQMAIACGSRAHLEKESIAQRSYFRTLLMYGFHFLVWFLCVKGIRDTQCGFKLFTREAASRTFSSLHVERWAFDVELLYIAQFFKIPIAEIAVNWTEIEGSKLVPFWSWLQMGKDLLFIRLRYLTGAWRLEQTRKMN

SEQ ID NO: 4089 - protein, 294 aa, Homo sapiens
  Payload ID: 922;
  Gene Symbol: ALG5;
  Gene Name: ALG5, dolichyl-phosphate beta-glucosyltransferase;
  Uniprot ID:  Q9Y673;
  ENSP ID: ENSP00000390533
MAPLLLQLAVLGAALAAAALVLISIVAFTTATKMPALHRHEEEKFFLNAKGQKETLPSIWDSPTKQLSVVVPSYNEEKRLPVMMDEALSYLEKRQKYGSDKVRVITLVKNRGKGGAIRMGIFSSRGEKILMADADGATKFPDVEKLEKGLNDLQPWPNQMAIACGSRAHLEKESIAQRSYFRTLLMYGFHFLVWFLCVKGIRDTQCGFKLFTREAASRTFSSLHVERWAFDVELLYIAQFFKIPIAEIAVNWTEIEGSKLVPFWSWLQMGKDLLFIRLRYLTGAWRLEQTRKMN

SEQ ID NO: 4090 - protein, 509 aa, Homo sapiens
  Payload ID: 923;
  Gene Symbol: ALG6;
  Gene Name: ALG6, alpha-1,3-glucosyltransferase;
  ENSP ID: ENSP00000263440
MEKWYLMTVVVLIGLTVRWTVSLNSYSGAGKPPMFGDYEAQRHWQEITFNLPVKQWYFNSSDNNLQYWGLDYPPLTAYHSLLCAYVAKFINPDWIALHTSRGYESQAHKLFMRTTVLIADLLIYIPAVVLYCCCLKEISTKKKIANALCILLYPGLILIDYGHFQNIYNSVSLGFALWGVLGISCDCDLLGSLAFCLAINYKQMELYHALPFFCFLLGKCFKKGLKGKGFVLLVKLACIVVASFVLCWLPFFTEREQTLQVLRRLFPVDRGLFEDKVANIWCSFNVFLKIKDILPRHIQLIMSFCSTFLSLLPACIKLILQPSSKGFKFTLVSCALSFFLFSFQVHEKSILLVSLPVCLVLSEIPFMSTWFLLVSTFSMLPLLLKDELLMPSVVTTMAFFIACVTSFSIFEKTSEEELQLKSFSISVRKYLPCFTFLSRIIQYLFLISVITMVLLTLMTVTLDPPQKLPDLFSVLVCFVSCLNFLFFLVYFNIIIMWDSKSGRNQKKIS

SEQ ID NO: 4091 - protein, 507 aa, Homo sapiens
  Payload ID: 923;
  Gene Symbol: ALG6;
  Gene Name: ALG6, alpha-1,3-glucosyltransferase;
  Uniprot ID:  Q9Y672;
  ENSP ID: ENSP00000360149
MEKWYLMTVVVLIGLTVRWTVSLNSYSGAGKPPMFGDYEAQRHWQEITFNLPVKQWYFNSSDNNLQYWGLDYPPLTAYHSLLCAYVAKFINPDWIALHTSRGYESQAHKLFMRTTVLIADLLIYIPAVVLYCCCLKEISTKKKIANALCILLYPGLILIDYGHFQYNSVSLGFALWGVLGISCDCDLLGSLAFCLAINYKQMELYHALPFFCFLLGKCFKKGLKGKGFVLLVKLACIVVASFVLCWLPFFTEREQTLQVLRRLFPVDRGLFEDKVANIWCSFNVFLKIKDILPRHIQLIMSFCSTFLSLLPACIKLILQPSSKGFKFTLVSCALSFFLFSFQVHEKSILLVSLPVCLVLSEIPFMSTWFLLVSTFSMLPLLLKDELLMPSVVTTMAFFIACVTSFSIFEKTSEEELQLKSFSISVRKYLPCFTFLSRIIQYLFLISVITMVLLTLMTVTLDPPQKLPDLFSVLVCFVSCLNFLFFLVYFNIIIMWDSKSGRNQKKIS

SEQ ID NO: 4092 - protein, 43 aa, Homo sapiens
  Payload ID: 923;
  Gene Symbol: ALG6;
  Gene Name: ALG6, alpha-1,3-glucosyltransferase;
  ENSP ID: ENSP00000473328
MEKWYLMTVVVLIGLTVRWTVSLNSYSGNTFLLVKKKTKFSFE

SEQ ID NO: 4093 - protein, 281 aa, Homo sapiens
  Payload ID: 923;
  Gene Symbol: ALG6;
  Gene Name: ALG6, alpha-1,3-glucosyltransferase;
  ENSP ID: ENSP00000473934
MEKWYLMTVVVLIGLTVRWTVSLNSYSGAGKPPMFGDYEAQRHWQEITFNLPVKQWYFNSSDNNLQYWGLDYPPLTAYHSLLCAYVAKFINPDWIALHTSRGYESQAHKLFMRTTVLIADLLIYIPAVVLYCCCLKEISTKKKIANALCILLYPGLILIDYGHFQNIYNSVSLGFALWGVLGISCDCDLLGSLAFCLAINYKQMELYHALPFFCFLLGKCFKKGLKGKGFVLLVKLACIVVASFVLCWLPFFTEREQTLQVLRRLFPVDRGLFEASFVLRF

SEQ ID NO: 4094 - protein, 526 aa, Homo sapiens
  Payload ID: 924;
  Gene Symbol: ALG8;
  Gene Name: ALG8, alpha-1,3-glucosyltransferase;
  Uniprot ID:  Q9BVK2;
  ENSP ID: ENSP00000299626
MAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILPSIFCLWFKPQGPRGFLRCLTLCALSSFMFGWHVHEKAILLAILPMSLLSVGKAGDASIFLILTTTGHYSLFPLLFTAPELPIKILLMLLFTIYSISSLKTLFRKEKPLFNWMETFYLLGLGPLEVCCEFVFPFTSWKVKYPFIPLLLTSVYCAVGITYAWFKLYVSVLIDSAIGKTKKQ

SEQ ID NO: 4095 - protein, 467 aa, Homo sapiens
  Payload ID: 924;
  Gene Symbol: ALG8;
  Gene Name: ALG8, alpha-1,3-glucosyltransferase;
  Uniprot ID:  Q9BVK2;
  ENSP ID: ENSP00000365326
MAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILPSIFCLWFKPQGPRGFLRCLTLCALSSFMFGWHVHEKAILLAILPMSLLSVGKAGDASIFLILTTTGHYSLFPLLFTAPELPIKILLMLLFTIYSISSLKTLFRRSFTLVAQAGVQWHDLS

SEQ ID NO: 4096 - protein, 96 aa, Homo sapiens
  Payload ID: 924;
  Gene Symbol: ALG8;
  Gene Name: ALG8, alpha-1,3-glucosyltransferase;
  ENSP ID: ENSP00000431357
MVVCIHHSTDFEVHRNWLAITHSLPISQWYYEATSEWTLDYPPFFAWFEYILSHVAKYFDQEMLNVHNLNYSSSRTLLFQRFSVIFMDVLFVYAVR

SEQ ID NO: 4097 - protein, 228 aa, Homo sapiens
  Payload ID: 924;
  Gene Symbol: ALG8;
  Gene Name: ALG8, alpha-1,3-glucosyltransferase;
  ENSP ID: ENSP00000432381
  MOD_RES (1)..(1): Any amino acid
XGLVVFLVSALSLGPFLALNQLPQVFSRLFPFKRGLCHAYWAPNFWALYNALDKVLSVIGPRGFLRCLTLCALSSFMFGWHVHEKAILLAILPMSLLSVGKAGDASIFLILTTTGHYSLFPLLFTAPELPIKILLMLLFTIYSISSLKTLFRKEKPLFNWMETFYLLGLGPLEVCCEFVFPFTSWKVKYPFIPLLLTSVYCAVGITYAWFKLYVSVLIDSAIGKTKKQ

SEQ ID NO: 4098 - protein, 157 aa, Homo sapiens
  Payload ID: 924;
  Gene Symbol: ALG8;
  Gene Name: ALG8, alpha-1,3-glucosyltransferase;
  ENSP ID: ENSP00000432953
  MOD_RES (1)..(1): Any amino acid
XIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGMVASIFYSDSEY

SEQ ID NO: 4099 - protein, 226 aa, Homo sapiens
  Payload ID: 924;
  Gene Symbol: ALG8;
  Gene Name: ALG8, alpha-1,3-glucosyltransferase;
  ENSP ID: ENSP00000433429
KRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILVQAILLPQPPEYLGIQPSIFCLWFKPQGPRGFLRCLTLCALSSFMFGWHVHEKAILLAILPM

SEQ ID NO: 4100 - protein, 87 aa, Homo sapiens
  Payload ID: 924;
  Gene Symbol: ALG8;
  Gene Name: ALG8, alpha-1,3-glucosyltransferase;
  ENSP ID: ENSP00000434066
  MOD_RES (1)..(1): Any amino acid
XSRLFPFKRGLCHAYWAPNFWALYNALDKVLSVIGLKLKFLDPNNIPKASMTSGLVQQFQHTVLPSVTPLATLICTLIAILKRKTSF

SEQ ID NO: 4101 - protein, 197 aa, Homo sapiens
  Payload ID: 924;
  Gene Symbol: ALG8;
  Gene Name: ALG8, alpha-1,3-glucosyltransferase;
  ENSP ID: ENSP00000434388
WFGSAVPTHSPSLSDSLGNPHLHTDCHIGPRGFLRCLTLCALSSFMFGWHVHEKAILLAILPMSLLSVGKAGDASIFLILTTTGHYSLFPLLFTAPELPIKILLMLLFTIYSISSLKTLFRKEKPLFNWMETFYLLGLGPLEVCCEFVFPFTSWKVKYPFIPLLLTSVYCAVGITYAWFKLYVSVLIDSAIGKTKKQ

SEQ ID NO: 4102 - protein, 282 aa, Homo sapiens
  Payload ID: 924;
  Gene Symbol: ALG8;
  Gene Name: ALG8, alpha-1,3-glucosyltransferase;
  ENSP ID: ENSP00000434660
MAALTIATGTGNWFSALALGVTLLKCLLIPTYSHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYW

SEQ ID NO: 4103 - protein, 172 aa, Homo sapiens
  Payload ID: 924;
  Gene Symbol: ALG8;
  Gene Name: ALG8, alpha-1,3-glucosyltransferase;
  ENSP ID: ENSP00000435417
MLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALN

SEQ ID NO: 4104 - protein, 242 aa, Homo sapiens
  Payload ID: 924;
  Gene Symbol: ALG8;
  Gene Name: ALG8, alpha-1,3-glucosyltransferase;
  ENSP ID: ENSP00000435467
MPSHPHIATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALD

SEQ ID NO: 4105 - protein, 281 aa, Homo sapiens
  Payload ID: 924;
  Gene Symbol: ALG8;
  Gene Name: ALG8, alpha-1,3-glucosyltransferase;
  ENSP ID: ENSP00000435626
  MOD_RES (1)..(1): Any amino acid
XIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALPSIFCLWFKPQGPRGFLRCLTLCALSSFMFGWHVHEKAILLAILPMSLLSVGKAGDASIFLILTTTGHYSLFPLLFTAPELPIKILLMLLFTIYSISSLKTLFRKEKPLFNWMETFYLLGLGPLEVCCEFVFPFTSWKVKYPFIPLLL

SEQ ID NO: 4106 - protein, 136 aa, Homo sapiens
  Payload ID: 924;
  Gene Symbol: ALG8;
  Gene Name: ALG8, alpha-1,3-glucosyltransferase;
  ENSP ID: ENSP00000436064
MLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKP

SEQ ID NO: 4107 - protein, 133 aa, Homo sapiens
  Payload ID: 924;
  Gene Symbol: ALG8;
  Gene Name: ALG8, alpha-1,3-glucosyltransferase;
  ENSP ID: ENSP00000436366
MAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRDCFCFFPNVSM

SEQ ID NO: 4108 - protein, 126 aa, Homo sapiens
  Payload ID: 924;
  Gene Symbol: ALG8;
  Gene Name: ALG8, alpha-1,3-glucosyltransferase;
  ENSP ID: ENSP00000437033
MDVGPRLKAWKPRSNHEMVVCIHHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGK

SEQ ID NO: 4109 - protein, 236 aa, Homo sapiens
  Payload ID: 924;
  Gene Symbol: ALG8;
  Gene Name: ALG8, alpha-1,3-glucosyltransferase;
  ENSP ID: ENSP00000437199
MAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQRQGLPILSRLVLNSWGQAILPRRLTKVLGLQVKGIWKEHFSLLFSYISSISTSM

SEQ ID NO: 4110 - protein, 467 aa, Homo sapiens; identical to SEQ ID NO: 4095
  Payload ID: 924;
  Gene Symbol: ALG8;
  Gene Name: ALG8, alpha-1,3-glucosyltransferase;
  Uniprot ID:  Q9BVK2;
  ENSP ID: ENSP00000480742

SEQ ID NO: 4111 - protein, 440 aa, Homo sapiens
  Payload ID: 925;
  Gene Symbol: ALG9;
  Gene Name: ALG9, alpha-1,2-mannosyltransferase;
  Uniprot ID:  Q9H6U8;
  ENSP ID: ENSP00000381090
MMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 4112 - protein, 207 aa, Homo sapiens
  Payload ID: 925;
  Gene Symbol: ALG9;
  Gene Name: ALG9, alpha-1,2-mannosyltransferase;
  ENSP ID: ENSP00000432442
  MOD_RES (1)..(1): Any amino acid
XTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGDRRRAEPTYRKN

SEQ ID NO: 4113 - protein, 447 aa, Homo sapiens
  Payload ID: 925;
  Gene Symbol: ALG9;
  Gene Name: ALG9, alpha-1,2-mannosyltransferase;
  Uniprot ID:  Q9H6U8;
  ENSP ID: ENSP00000435517
MMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQHSFLYFQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 4114 - protein, 35 aa, Homo sapiens
  Payload ID: 925;
  Gene Symbol: ALG9;
  Gene Name: ALG9, alpha-1,2-mannosyltransferase;
  ENSP ID: ENSP00000436798
  MOD_RES (1)..(1): Any amino acid
XKYSSNKEEWISLAYRPFLDASSFEGWKTKITMPV

SEQ ID NO: 4115 - protein, 24 aa, Homo sapiens
  Payload ID: 925;
  Gene Symbol: ALG9;
  Gene Name: ALG9, alpha-1,2-mannosyltransferase;
  ENSP ID: ENSP00000437211
  MOD_RES (1)..(1): Any amino acid
XEEWISLAYRPFLDASRVSLCCPG

SEQ ID NO: 4116 - protein, 134 aa, Homo sapiens
  Payload ID: 925;
  Gene Symbol: ALG9;
  Gene Name: ALG9, alpha-1,2-mannosyltransferase;
  ENSP ID: ENSP00000478246
MASRGARQRLKGSGASSGDTAPAADKLRELLGSREAGGAEHRTELSGNKAGQVWAPEGSTAFKCLLSARLCAALLSNISDCDETFNYWEPVDTLPHLWGRVSDLGIFPSICHSLLCLPVASCLASCISCKNSTN

SEQ ID NO: 4117 - protein, 168 aa, Homo sapiens
  Payload ID: 925;
  Gene Symbol: ALG9;
  Gene Name: ALG9, alpha-1,2-mannosyltransferase;
  ENSP ID: ENSP00000479335
MASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKGCVQEVWVARESNDASLLGSQHWHVLLIISIPS

SEQ ID NO: 4118 - protein, 102 aa, Homo sapiens
  Payload ID: 925;
  Gene Symbol: ALG9;
  Gene Name: ALG9, alpha-1,2-mannosyltransferase;
  ENSP ID: ENSP00000480661
MASRGARQRLKGSGASSGDTAPAADKLRELLGSREAGGAEHRTEHTTSSMGKGFRLGNIPQHMPFAPMLTCCFMPGQLHFMQEFYKLIRFLCFTFCDVFWLL

SEQ ID NO: 4119 - protein, 618 aa, Homo sapiens
  Payload ID: 925;
  Gene Symbol: ALG9;
  Gene Name: ALG9, alpha-1,2-mannosyltransferase;
  Uniprot ID:  Q9H6U8;
  ENSP ID: ENSP00000482437
MASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQHSFLYFQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 4120 - protein, 198 aa, Homo sapiens
  Payload ID: 925;
  Gene Symbol: ALG9;
  Gene Name: ALG9, alpha-1,2-mannosyltransferase;
  ENSP ID: ENSP00000482975
MASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSVYPLPLICWS

SEQ ID NO: 4121 - protein, 611 aa, Homo sapiens
  Payload ID: 925;
  Gene Symbol: ALG9;
  Gene Name: ALG9, alpha-1,2-mannosyltransferase;
  Uniprot ID:  Q9H6U8;
  ENSP ID: ENSP00000484200
MASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 4122 - protein, 264 aa, Homo sapiens
  Payload ID: 926;
  Gene Symbol: ACER1;
  Gene Name: alkaline ceramidase 1;
  Uniprot ID:  Q8TDN7;
  ENSP ID: ENSP00000301452
MPSIFAYQSSEVDWCESNFQYSELVAEFYNTFSNIPFFIFGPLMMLLMHPYAQKRSRYIYVVWVLFMIIGLFSMYFHMTLSFLGQLLDEIAILWLLGSGYSIWMPRCYFPSFLGGNRSQFIRLVFITTVVSTLLSFLRPTVNAYALNSIALHILYIVCQEYRKTSNKELRHLIEVSVVLWAVALTSWISDRLLCSFWQRIHFFYLHSIWHVLISITFPYGMVTMALVDANYEMPGETLKVRYWPRDSWPVGLPYVEIRGDDKDC

SEQ ID NO: 4123 - protein, 275 aa, Homo sapiens [sequence omitted]

SEQ ID NO: 4124 - protein, 76 aa, Homo sapiens
  Payload ID: 928;
  Gene Symbol: ACER3;
  Gene Name: alkaline ceramidase 3;
  ENSP ID: ENSP00000278544
MAPAADREGYWGPTTSTLDWCEENYSVTWYIAEFWNTVSNLIMIIPPMFGAVQSVRDGLEKRYIASYLALTEVLQI

SEQ ID NO: 4125 - protein, 172 aa, Homo sapiens
  Payload ID: 928;
  Gene Symbol: ACER3;
  Gene Name: alkaline ceramidase 3;
  ENSP ID: ENSP00000431149
MIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 4126 - protein, 51 aa, Homo sapiens
  Payload ID: 928;
  Gene Symbol: ACER3;
  Gene Name: alkaline ceramidase 3;
  ENSP ID: ENSP00000431504
MAPAADREGYWGPTTSTLDWCEENYSVTWYIAEFCSFLPSSLKSNLKEYSE

SEQ ID NO: 4127 - protein, 51 aa, Homo sapiens; identical to SEQ ID NO: 4126
  Payload ID: 928;
  Gene Symbol: ACER3;
  Gene Name: alkaline ceramidase 3;
  ENSP ID: ENSP00000432109

SEQ ID NO: 4128 - protein, 80 aa, Homo sapiens
  Payload ID: 928;
  Gene Symbol: ACER3;
  Gene Name: alkaline ceramidase 3;
  ENSP ID: ENSP00000432379
MAPAADREGYWGPTTSTLDWCEENYSVTWYIAEFWNTVSNLIMIIPPMFGAVQSVRDGLEKRYIASYLALTDGVSLCRRG

SEQ ID NO: 4129 - protein, 74 aa, Homo sapiens
  Payload ID: 928;
  Gene Symbol: ACER3;
  Gene Name: alkaline ceramidase 3;
  ENSP ID: ENSP00000433368
MAPAADREGYWGPTTSTLDWCEENYSVTWYIAEFWNTVSNLIMIIPPMFGAVQSVRDGLEKRYIASYLALTAIG

SEQ ID NO: 4130 - protein, 267 aa, Homo sapiens [sequence omitted]

SEQ ID NO: 4131 - protein, 71 aa, Homo sapiens
  Payload ID: 928;
  Gene Symbol: ACER3;
  Gene Name: alkaline ceramidase 3;
  ENSP ID: ENSP00000435048
MAPAADREGYWGPTTSTLDWCEENYSVTWYIAEFCSFLPSSLKSNLKLVSTHQASFLVLGLWAGRGDIPVI

SEQ ID NO: 4132 - protein, 205 aa, Homo sapiens
  Payload ID: 928;
  Gene Symbol: ACER3;
  Gene Name: alkaline ceramidase 3;
  ENSP ID: ENSP00000435733
MIIPPMFGAVQSVRDGLEKRYIASYLALTVVGMGSWCFHMTLKYEMQLLDELPMIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRP

SEQ ID NO: 4133 - protein, 230 aa, Homo sapiens
  Payload ID: 928;
  Gene Symbol: ACER3;
  Gene Name: alkaline ceramidase 3;
  ENSP ID: ENSP00000436252
MAPAADREGYWGPTTSTLDWCEENYSVTWYIAEFLVGMGSWCFHMTLKYEMQLLDELPMIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 4134 - protein, 528 aa, Homo sapiens
  Payload ID: 929;
  Gene Symbol: ALPI;
  Gene Name: alkaline phosphatase, intestinal;
  Uniprot ID:  P09923;
  ENSP ID: ENSP00000295463
MQGPWVLLLLGLRLQLSLGVIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPACTTDAAHPVAASLPLLAGTLLLLGASAAP

SEQ ID NO: 4135 - protein, 50 aa, Homo sapiens
  Payload ID: 929;
  Gene Symbol: ALPI;
  Gene Name: alkaline phosphatase, intestinal;
  ENSP ID: ENSP00000413068
MQGPWVLLLLGLRLQLSLGVIPGNEAPQAVPHTGHPLSQADLISTLPLAS

SEQ ID NO: 4136 - protein, 216 aa, Homo sapiens
  Payload ID: 930;
  Gene Symbol: ALPL;
  Gene Name: alkaline phosphatase, liver/bone/kidney;
  ENSP ID: ENSP00000363963
  MOD_RES (1)..(1): Any amino acid
XHSHFIWNRTELLTLDPHNVDYLLGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 4137 - protein, 524 aa, Homo sapiens
  Payload ID: 930;
  Gene Symbol: ALPL;
  Gene Name: alkaline phosphatase, liver/bone/kidney;
  Uniprot ID:  P05186;
  ENSP ID: ENSP00000363965
MISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 4138 - protein, 524 aa, Homo sapiens; identical to SEQ ID NO: 4137
  Payload ID: 930;
  Gene Symbol: ALPL;
  Gene Name: alkaline phosphatase, liver/bone/kidney;
  Uniprot ID:  P05186;
  ENSP ID: ENSP00000363973

SEQ ID NO: 4139 - protein, 447 aa, Homo sapiens
  Payload ID: 930;
  Gene Symbol: ALPL;
  Gene Name: alkaline phosphatase, liver/bone/kidney;
  Uniprot ID:  P05186;
  ENSP ID: ENSP00000437674
MPWSFRSSTPTWLRMSSCSWEMTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 4140 - protein, 469 aa, Homo sapiens
  Payload ID: 930;
  Gene Symbol: ALPL;
  Gene Name: alkaline phosphatase, liver/bone/kidney;
  Uniprot ID:  P05186;
  ENSP ID: ENSP00000442672
MFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 4141 - protein, 535 aa, Homo sapiens
  Payload ID: 931;
  Gene Symbol: ALPP;
  Gene Name: alkaline phosphatase, placental;
  Uniprot ID:  P05187;
  ENSP ID: ENSP00000375881
MLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 4142 - protein, 532 aa, Homo sapiens
  Payload ID: 932;
  Gene Symbol: ALPPL2;
  Gene Name: alkaline phosphatase, placental-like 2;
  Uniprot ID:  P10696;
  ENSP ID: ENSP00000295453
MQGPWVLLLLGLRLQLSLGIIPVEEENPDFWNRQAAEALGAAKKLQPAQTAAKNLIIFLGDGMGVSTVTAARILKGQKKDKLGPETFLAMDRFPYVALSKTYSVDKHVPDSGATATAYLCGVKGNFQTIGLSAAARFNQCNTTRGNEVISVMNRAKKAGKSVGVVTTTRVQHASPAGAYAHTVNRNWYSDADVPASARQEGCQDIATQLISNMDIDVILGGGRKYMFPMGTPDPEYPDDYSQGGTRLDGKNLVQEWLAKHQGARYVWNRTELLQASLDPSVTHLMGLFEPGDMKYEIHRDSTLDPSLMEMTEAALLLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDGETHAGEDVAVFARGPQAHLVHGVQEQTFIAHVMAFAACLEPYTACDLAPRAGTTDAAHPGPSVVPALLPLLAGTLLLLGTATAP

SEQ ID NO: 4143 - protein, 531 aa, Homo sapiens
  Payload ID: 932;
  Gene Symbol: ALPPL2;
  Gene Name: alkaline phosphatase, placental-like 2;
  ENSP ID: ENSP00000483564
MQGPWVLLLLGLRLQLSLGIIPVEEENPDFWNRQAAEALGAAKKLQPAQTAAKNLIIFLGDGMGVSTVTAARILKGQKKDKLGPETFLAMDRFPYVALSKTYSVDKHVPDSGATATAYLCGVKGNFQTIGLSAAARFNQCNTTRGNEVISVMNRAKKAGKSVGVVTTTRVQHASPAGAYAHTVNRNWYSDADVPASARQEGCQDIATQLISNMDIDVILGGGRKYMFPMGTPDPEYPDDYSQGGTRLDGKNLVQEWLAKHQGARYVWNRTELLQASLDPSVTHLMGLFEPGDMKYEIHRDSTLDPSLMEMTEAALLLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLTETHAGEDVAVFARGPQAHLVHGVQEQTFIAHVMAFAACLEPYTACDLAPRAGTTDAAHPGPSVVPALLPLLAGTLLLLGTATAP

SEQ ID NO: 4144 - protein, 389 aa, Homo sapiens
  Payload ID: 933;
  Gene Symbol: ALKBH1;
  Gene Name: alkB homolog 1, histone H2A dioxygenase;
  Uniprot ID:  Q13686;
  ENSP ID: ENSP00000216489
MGKMAAAVGSVATLATEPGEDAFRKLFRFYRQSRPGTADLEGVIDFSAAHAARGKGPGAQKVIKSQLNVSSVSEQNAYRAGLQPVSKWQAYGLKGYPGFIFIPNPFLPGYQWHWVKQCLKLYSQKPNVCNLDKHMSKEETQDLWEQSKEFLRYKEATKRRPRSLLEKLRWVTVGYHYNWDSKKYSADHYTPFPSDLGFLSEQVAAACGFEDFRAEAGILNYYRLDSTLGIHVDRSELDHSKPLLSFSFGQSAIFLLGGLQRDEAPTAMFMHSGDIMIMSGFSRLLNHAVPRVLPNPEGEGLPHCLEAPLPAVLPRDSMVEPCSMEDWQVCASYLKTARVNMTVRQVLATDQNFPLEPIEDEKRDISTEGFCHLDDQNSEVKRARINPDS

SEQ ID NO: 4145 - protein, 112 aa, Homo sapiens
  Payload ID: 933;
  Gene Symbol: ALKBH1;
  Gene Name: alkB homolog 1, histone H2A dioxygenase;
  ENSP ID: ENSP00000451386
AAAVGSVATLATEPGEDAFRKLFRFYRQSRPGTADLEGVIDFSAAHAARGKGPGAQKVIKSQLNVSSVSEQNAYRAGLQPVSKWQAYGLKGYPGIKKRLNGDPEVYWRNCVG

SEQ ID NO: 4146 - protein, 116 aa, Homo sapiens
  Payload ID: 933;
  Gene Symbol: ALKBH1;
  Gene Name: alkB homolog 1, histone H2A dioxygenase;
  ENSP ID: ENSP00000451886
MGKMAAAVGSVATLATEPGEDAFRKLFRFYRQSRPGTADLEGVIDFSAAHAARGKGPGAQKVIKSQLNVSSVSEQNAYRAGLQPVSKWQAYGLKGYPGIKKRLNGDPEVYWRNCVG

SEQ ID NO: 4147 - protein, 261 aa, Homo sapiens
  Payload ID: 934;
  Gene Symbol: ALKBH2;
  Gene Name: alkB homolog 2, alpha-ketoglutarate-dependent dioxygenase;
  Uniprot ID:  Q6NS38;
  ENSP ID: ENSP00000343021
MDRFLVKGAQGGLLRKQEEQEPTGEEPAVLGGDKESTRKRPRREAPGNGGHSAGPSWRHIRAEGLDCSYTVLFGKAEADEIFQELEKEVEYFTGALARVQVFGKWHSVPRKQATYGDAGLTYTFSGLTLSPKPWIPVLERIRDHVSGVTGQTFNFVLINRYKDGCDHIGEHRDDERELAPGSPIASVSFGACRDFVFRHKDSRGKSPSRRVAVVRLPLAHGSLLMMNHPTNTHWYHSLPVRKKVLAPRVNLTFRKILLTKK

SEQ ID NO: 4148 - protein, 261 aa, Homo sapiens; identical to SEQ ID NO: 4147
  Payload ID: 934;
  Gene Symbol: ALKBH2;
  Gene Name: alkB homolog 2, alpha-ketoglutarate-dependent dioxygenase;
  Uniprot ID:  Q6NS38;
  ENSP ID: ENSP00000398181

SEQ ID NO: 4149 - protein, 157 aa, Homo sapiens
  Payload ID: 934;
  Gene Symbol: ALKBH2;
  Gene Name: alkB homolog 2, alpha-ketoglutarate-dependent dioxygenase;
  Uniprot ID:  Q6NS38;
  ENSP ID: ENSP00000399820
MDRFLVKGAQGGLLRKQEEQEPTGEEPAVLGGDKESTRKRPRREAPGNGGHSAGPSWRHIRAEGLDCSYTVLFGKAEADEIFQELEKEVEYFTGIKMAVTTSGSTEMMKENWPLGAPLPLSPSVPAETLSSGIRIPVGKAPPGGWRWSGCRWPTGAY

SEQ ID NO: 4150 - protein, 150 aa, Homo sapiens
  Payload ID: 934;
  Gene Symbol: ALKBH2;
  Gene Name: alkB homolog 2, alpha-ketoglutarate-dependent dioxygenase;
  ENSP ID: ENSP00000443042
MDRFLVKGAQGGLLRKQEEQEPTGEEPAVLGGDKESTRKRPRREAPGNGGHSAGPSWRHIRAEGLDCSYTVLFGKAEADEIFQELEKEVEYFTGALARVQVFGKWHSVPRKQATYGDAGLTYTFSGLTLSPKPWIPVLERIRDHVSGVTG

SEQ ID NO: 4151 - protein, 121 aa, Homo sapiens
  Payload ID: 934;
  Gene Symbol: ALKBH2;
  Gene Name: alkB homolog 2, alpha-ketoglutarate-dependent dioxygenase;
  ENSP ID: ENSP00000444103
MDRFLVKGAQGGLLRKQEEQEPTGEEPAVLGGDKESTRKRPRREAPGNGGHSAGPSWRHIRAEGLDCSYTVLFGKAEADEIFQELEKEVEYFTGALARVQVFGKWHSVPRKQATYGDAGLT

SEQ ID NO: 4152 - protein, 149 aa, Homo sapiens
  Payload ID: 934;
  Gene Symbol: ALKBH2;
  Gene Name: alkB homolog 2, alpha-ketoglutarate-dependent dioxygenase;
  ENSP ID: ENSP00000474702
  MOD_RES (1)..(1): Any amino acid
XLLRKQEEQEPTGEEPAVLGGDKESTRKRPRREAPGNGGHSAGPSWRHIRAEGLDCSYTVLFGKAEADEIFQELEKEVEYFTGALARVQVFGKWHSVPRKQATYGDAGLTYTFSGLTLSPKPWIPVLERIRDHVSGVTGQTFNFVLINR

SEQ ID NO: 4153 - protein, 157 aa, Homo sapiens; identical to SEQ ID NO: 4149
  Payload ID: 934;
  Gene Symbol: ALKBH2;
  Gene Name: alkB homolog 2, alpha-ketoglutarate-dependent dioxygenase;
  Uniprot ID:  Q6NS38;
  ENSP ID: ENSP00000478765

SEQ ID NO: 4154 - protein, 286 aa, Homo sapiens
  Payload ID: 935;
  Gene Symbol: ALKBH3;
  Gene Name: alkB homolog 3, alpha-ketoglutarate-dependent dioxygenase;
  Uniprot ID:  Q96Q83;
  ENSP ID: ENSP00000302232
MEEKRRRARVQGAWAAPVKSQAIAQPATTAKSHLHQKPGQTWKNKEHHLSDREFVFKEPQQVVRRAPEPRVIDREGVYEISLSPTGVSRVCLYPGFVDVKEADWILEQLCQDVPWKQRTGIREDITYQQPRLTAWYGELPYTYSRITMEPNPHWHPVLRTLKNRIEENTGHTFNSLLCNLYRNEKDSVDWHSDDEPSLGRCPIIASLSFGATRTFEMRKKPPPEENGDYTYVERVKIPLDHGTLLIMEGATQADWQHRVPKEYHSREPRVNLTFRTVYPDPRGAPW

SEQ ID NO: 4155 - protein, 66 aa, Homo sapiens
  Payload ID: 935;
  Gene Symbol: ALKBH3;
  Gene Name: alkB homolog 3, alpha-ketoglutarate-dependent dioxygenase;
  ENSP ID: ENSP00000432259
MEEKRRRARVQGAWAAPVKSQAIAQPATTAKSHLHQKPGQTWKNKEHHLSDREFVFKEPQQQRGCV

SEQ ID NO: 4156 - protein, 156 aa, Homo sapiens
  Payload ID: 935;
  Gene Symbol: ALKBH3;
  Gene Name: alkB homolog 3, alpha-ketoglutarate-dependent dioxygenase;
  ENSP ID: ENSP00000433614
  MOD_RES (1)..(1): Any amino acid
XLTGYWNSFVKMFPGNRGLASERWHPVLRTLKNRIEENTGHTFNSLLCNLYRNEKDSVDWHSDDEPSLGRCPIIASLSFGATRTFEMRKKPPPEENGDYTYVERVKIPLDHGTLLIMEGATQADWQHRVPKEYHSREPRVNLTFRTVYPDPRGAPW

SEQ ID NO: 4157 - protein, 60 aa, Homo sapiens
  Payload ID: 935;
  Gene Symbol: ALKBH3;
  Gene Name: alkB homolog 3, alpha-ketoglutarate-dependent dioxygenase;
  ENSP ID: ENSP00000434229
MEEKRRRARVQGAWAAPVKSQAIAQPATTAKSHLHQKPGQTWKNKEHHLSDREFVFKEPQ

SEQ ID NO: 4158 - protein, 171 aa, Homo sapiens
  Payload ID: 935;
  Gene Symbol: ALKBH3;
  Gene Name: alkB homolog 3, alpha-ketoglutarate-dependent dioxygenase;
  ENSP ID: ENSP00000434832
MEEKRRRARVQGAWAAPVKSQAIAQPATTAKSHLHQKPGQTWKNKEHHLSDREFVFKEPQQVVRRAPEPRVIDREGVYEISLSPTGVSRVCLYPGFVDVKEADWILEQLCQDVPWKQRTGIREDSILQLTFKKSAPVSGTATAPQSCWYERPSPPHIPGPAILTRTRLWAP

SEQ ID NO: 4159 - protein, 223 aa, Homo sapiens
  Payload ID: 935;
  Gene Symbol: ALKBH3;
  Gene Name: alkB homolog 3, alpha-ketoglutarate-dependent dioxygenase;
  ENSP ID: ENSP00000435848
MEEKRRRARVQGAWAAPVKSQAIAQPATTAKSHLHQKPGQTWKNKEHHLSDREFVFKEPQQVVRRAPEPRVIEEGVYEISLSPTGVSRVCLYPGFVDVKEADWILEQLCQDVPWKQRTGIREDITYQQPRLTAWYGELPYTYSRITMEPNPHWHPVLRTLKNRIEENTGHTFNSLLCNLYRNEKDSVDWHSDDEPSLGRCPIIASLSFGATRTFEMRKKPPPE

SEQ ID NO: 4160 - protein, 170 aa, Homo sapiens
  Payload ID: 935;
  Gene Symbol: ALKBH3;
  Gene Name: alkB homolog 3, alpha-ketoglutarate-dependent dioxygenase;
  Uniprot ID:  Q96Q83;
  ENSP ID: ENSP00000436788
MEEKRRRARVQGAWAAPVKSQAIAQPATTAKSHLHQKPGQTWKNKEHHLSDREFVFKEPQQVVRRAPEPRVIEEGVYEISLSPTGVSRVCLYPGFVDVKEADWILEQLCQDVPWKQRTGIREDSILQLTFKKSAPVSGTATAPQSCWYERPSPPHIPGPAILTRTRLWAP

SEQ ID NO: 4161 - protein, 302 aa, Homo sapiens
  Payload ID: 936;
  Gene Symbol: ALKBH4;
  Gene Name: alkB homolog 4, lysine demthylase;
  Uniprot ID:  Q9NXW9;
  ENSP ID: ENSP00000292566
MAAAAAETPEVLRECGCKGIRTCLICERQRGSDPPWELPPAKTYRFIYCSDTGWAVGTEESDFEGWAFPFPGVMLIEDFVTREEEAELVRLMDRDPWKLSQSGRRKQDYGPKVNFRKQKLKTEGFCGLPSFSREVVRRMGLYPGLEGFRPVEQCNLDYCPERGSAIDPHLDDAWLWGERLVSLNLLSPTVLSMCREAPGSLLLCSAPSAAPEALVDSVIAPSRSVLCQEVEVAIPLPARSLLVLTGAARHQWKHAIHRRHIEARRVCVTFRELSAEFGPGGRQQELGQELLRIALSFQGRPV

SEQ ID NO: 4162 - protein, 42 aa, Homo sapiens
  Payload ID: 936;
  Gene Symbol: ALKBH4;
  Gene Name: alkB homolog 4, lysine demthylase;
  Uniprot ID:  Q9NXW9;
  ENSP ID: ENSP00000420362
MAAAAAETPEVLRECGCKGIRTCLICERQRGSDPPWELPPAE

SEQ ID NO: 4163 - protein, 394 aa, Homo sapiens
  Payload ID: 937;
  Gene Symbol: ALKBH5;
  Gene Name: alkB homolog 5, RNA demethylase;
  Uniprot ID:  Q6P6C2;
  ENSP ID: ENSP00000382091
MAAASGYTDLREKLKSMTSRDNYKAGSREAAAAAAAAVAAAAAAAAAAEPYPVSGAKRKYQEDSDPERSDYEEQQLQKEEEARKVKSGIRQMRLFSQDECAKIEARIDEVVSRAEKGLYNEHTVDRAPLRNKYFFGEGYTYGAQLQKRGPGQERLYPPGDVDEIPEWVHQLVIQKLVEHRVIPEGFVNSAVINDYQPGGCIVSHVDPIHIFERPIVSVSFFSDSALCFGCKFQFKPIRVSEPVLSLPVRRGSVTVLSGYAADEITHCIRPQDIKERRAVIILRKTRLDAPRLETKSLSSSVLPPSYASDRLSGNNRDPALKPKRSHRKADPDAAHRPRILEMDKEENRRSVLLPTHRRRGSFSSENYWRKSYESSEDCSEAAGSPARKVKMRRH

SEQ ID NO: 4164 - protein, 53 aa, Homo sapiens
  Payload ID: 937;
  Gene Symbol: ALKBH5;
  Gene Name: alkB homolog 5, RNA demethylase;
  ENSP ID: ENSP00000468116
MDKEENRRSVLLPTHRRRGSFSSENYWRKSYESSEDCSEAAGSPARKVKMRRH

SEQ ID NO: 4165 - protein, 238 aa, Homo sapiens
  Payload ID: 938;
  Gene Symbol: ALKBH6;
  Gene Name: alkB homolog 6;
  Uniprot ID:  Q3KRA9;
  ENSP ID: ENSP00000252984
MEEQDARVPALEPFRVEQAPPVIYYVPDFISKEEEEYLLRQVFNAPKPKWTQLSGRKLQNWGGLPHPRGMVPERLPPWLQRYVDKVSNLSLFGGLPANHVLVNQYLPGEGIMPHEDGPLYYPTVSTISLGSHTVLDFYEPRRPEDDDPTEQPRPPPRPTTSLLLEPRSLLVLRGPAYTRLLHGIAAARVDALDAASSPPNAAACPSARPGACLVRGTRVSLTIRRVPRVLRAGLLLGK

SEQ ID NO: 4166 - protein, 266 aa, Homo sapiens
  Payload ID: 938;
  Gene Symbol: ALKBH6;
  Gene Name: alkB homolog 6;
  Uniprot ID:  Q3KRA9;
  ENSP ID: ENSP00000368152
MAGRGMGMLNLEIGGDAGGRIGCKELVLMEEQDARVPALEPFRVEQAPPVIYYVPDFISKEEEEYLLRQVFNAPKPKWTQLSGRKLQNWGGLPHPRGMVPERLPPWLQRYVDKVSNLSLFGGLPANHVLVNQYLPGEGIMPHEDGPLYYPTVSTISLGSHTVLDFYEPRRPEDDDPTEQPRPPPRPTTSLLLEPRSLLVLRGPAYTRLLHGIAAARVDALDAASSPPNAAACPSARPGACLVRGTRVSLTIRRVPRVLRAGLLLGK

SEQ ID NO: 4167 - protein, 50 aa, Homo sapiens
  Payload ID: 938;
  Gene Symbol: ALKBH6;
  Gene Name: alkB homolog 6;
  ENSP ID: ENSP00000433085
  MOD_RES (1)..(1): Any amino acid
XEIGGDAGGRIGCKELVLMEEQDARVPALEPFRVEQVVRTQGTTCNLLCP

SEQ ID NO: 4168 - protein, 93 aa, Homo sapiens
  Payload ID: 938;
  Gene Symbol: ALKBH6;
  Gene Name: alkB homolog 6;
  ENSP ID: ENSP00000433156
WWTAPPVIYYVPDFISKEEEEYLLRQVFNAPKPKWTQLSGRKLQNWGPHCLPQVGFLIPEGWFLSGCPHGSSATWTKCQTSASLEASQLTMSS

SEQ ID NO: 4169 - protein, 47 aa, Homo sapiens
  Payload ID: 938;
  Gene Symbol: ALKBH6;
  Gene Name: alkB homolog 6;
  ENSP ID: ENSP00000433885
  MOD_RES (1)..(1): Any amino acid
XIGCKELVLMEEQDARVPALEPFRVEQVVRTQGAEGEGGTTCNLLCP

SEQ ID NO: 4170 - protein, 132 aa, Homo sapiens
  Payload ID: 938;
  Gene Symbol: ALKBH6;
  Gene Name: alkB homolog 6;
  ENSP ID: ENSP00000435496
  MOD_RES (1)..(1): Any amino acid
XNLEIGGDAGGRIGCKELVLMEEQDARVPALEPFRVEQAPPVIYYVPDFISKEEEEYLLRQVFNAPKPKWTQLSGRKLQNWGGPSGPHCLPQVGFLIPEGWFLSGCPHGSSATWTKCQTSASLEASQLTMSS

SEQ ID NO: 4171 - protein, 72 aa, Homo sapiens
  Payload ID: 938;
  Gene Symbol: ALKBH6;
  Gene Name: alkB homolog 6;
  ENSP ID: ENSP00000436156
  MOD_RES (1)..(1): Any amino acid
XDAGGRIGCKELVLMEEQDARVPALEPFRVEQAPPVIYYVPDFISKEEEEYLLRQVTSVPYWWASSSPRDGS

SEQ ID NO: 4172 - protein, 133 aa, Homo sapiens
  Payload ID: 938;
  Gene Symbol: ALKBH6;
  Gene Name: alkB homolog 6;
  ENSP ID: ENSP00000436742
MEEQDARVPALEPFRVEQAPPVIYYVPDFISKEEEEYLLRQVFNAPKPKWTQLSGRKLQNWGGLPHPRGMVPERLPPWLQRYVDKVSNLSLFGGLPANHVLVNQYLPGEGIMHHQPGLPHRAGLLRAAAARGR

SEQ ID NO: 4173 - protein, 110 aa, Homo sapiens
  Payload ID: 938;
  Gene Symbol: ALKBH6;
  Gene Name: alkB homolog 6;
  ENSP ID: ENSP00000474158
MEEQDARVPALEPFRVEQVFNAPKPKWTQLSGRKLQNWGGLPHPRGMVPERLPPWLQRYVDKVSNLSLFGGLPANHVLVNQYLPGEGIMHHQPGLPHRAGLLRAAAARGR

SEQ ID NO: 4174 - protein, 221 aa, Homo sapiens
  Payload ID: 939;
  Gene Symbol: ALKBH7;
  Gene Name: alkB homolog 7;
  Uniprot ID:  Q9BT30;
  ENSP ID: ENSP00000245812
MAGTGLLALRTLPGPSWVRGSGPSVLSRLQDAAVVRPGFLSTAEEETLSRELEPELRRRRYEYDHWDAAIHGFRETEKSRWSEASRAILQRVQAAAFGPGQTLLSSVHVLDLEARGYIKPHVDSIKFCGATIAGLSLLSPSVMRLVHTQEPGEWLELLLEPGSLYILRGSARYDFSHEILRDEESFFGERRIPRGRRISVICRSLPEGMGPGESGQPPPAC

SEQ ID NO: 4175 - protein, 79 aa, Homo sapiens
  Payload ID: 939;
  Gene Symbol: ALKBH7;
  Gene Name: alkB homolog 7;
  ENSP ID: ENSP00000470542
MRLVHTQEPGEWLELLLEPGSLYILRGSARYDFSHEILRDEESFFGERRIPRGRRISVICRSLPEGMGPGESGQPPPAC

SEQ ID NO: 4176 - protein, 160 aa, Homo sapiens
  Payload ID: 939;
  Gene Symbol: ALKBH7;
  Gene Name: alkB homolog 7;
  ENSP ID: ENSP00000470562
MGQGLFGAIHGFRETEKSRWSEASRAILQRVQAAAFGPGQTLLSSVHVLDLEARGYIKPHVDSIKFCGATIAGLSLLSPSVMRLVHTQEPGEWLELLLEPGSLYILRGSARYDFSHEILRDEESFFGERRIPRGRRISVICRSLPEGMGPGESGQPPPAC

SEQ ID NO: 4177 - protein, 238 aa, Homo sapiens
  Payload ID: 940;
  Gene Symbol: ALKBH8;
  Gene Name: alkB homolog 8, tRNA methyltransferase;
  Uniprot ID:  Q96BT7;
  ENSP ID: ENSP00000260318
MDSNHQSNYKLSKTEKKFLRKQIKAKHTLLRHEGIETVSYATQSLVVANGGLGNGVSRNQLLPVLEKCGLVDALLMPPNKPYSFARYRTTEESKRAYVTLNGKEVVDDLGQKITLYLNFVEKVQWKELRPQALPPGLMVVEEIISSEEEKMLLESVDWTEDTDNQNSQKSLKHRRVKHFGYEFHYENNNVDKDKPLSGGLPDICESFLEKWLRKGYIKHKPDQMTINQYEPGQDCHGF

SEQ ID NO: 4178 - protein, 664 aa, Homo sapiens
  Payload ID: 940;
  Gene Symbol: ALKBH8;
  Gene Name: alkB homolog 8, tRNA methyltransferase;
  Uniprot ID:  Q96BT7;
  ENSP ID: ENSP00000374219
MDSNHQSNYKLSKTEKKFLRKQIKAKHTLLRHEGIETVSYATQSLVVANGGLGNGVSRNQLLPVLEKCGLVDALLMPPNKPYSFARYRTTEESKRAYVTLNGKEVVDDLGQKITLYLNFVEKVQWKELRPQALPPGLMVVEEIISSEEEKMLLESVDWTEDTDNQNSQKSLKHRRVKHFGYEFHYENNNVDKDKPLSGGLPDICESFLEKWLRKGYIKHKPDQMTINQYEPGQGIPAHIDTHSAFEDEIVSLSLGSEIVMDFKHPDGIAVPVMLPRRSLLVMTGESRYLWTHGITCRKFDTVQASESLKSGIITSDVGDLTLSKRGLRTSFTFRKVRQTPCNCSYPLVCDSQRKETPPSFPESDKEASRLEQEYVHQVYEEIAGHFSSTRHTPWPHIVEFLKALPSGSIVADIGCGNGKYLGINKELYMIGCDRSQNLVDICRERQFQAFVCDALAVPVRSGSCDACISIAVIHHFATAERRVAALQEIVRLLRPGGKALIYVWAMEQEYNKQKSKYLRGNRNSQGKKEEMNSDTSVQRSLVEQMRDMGSRDSASSVPRINDSQEGGCNSRQVSNSKLPVHVNRTSFYSQDVLVPWHLKGNPDKGKPVEPFGPIGSQDPSPVFHRYYHVFREGELEGACRTVSDVRILQSYYDQGNWCVILQKA

SEQ ID NO: 4179 - protein, 144 aa, Homo sapiens
  Payload ID: 940;
  Gene Symbol: ALKBH8;
  Gene Name: alkB homolog 8, tRNA methyltransferase;
  ENSP ID: ENSP00000376812
MDSNHQSNYKLSKTEKKFLRKQIKAKHTLLRHEGIETVSYATQSLVVANGGLGNGVSRNQLLPVLEKCGLVDALLMPPNKPYSFARYRTTEESKRAYVTLNGKEVVDDLGQKITLYLNFVEKVEGVEASSLTTRTHGSRRNNFF

SEQ ID NO: 4180 - protein, 224 aa, Homo sapiens
  Payload ID: 940;
  Gene Symbol: ALKBH8;
  Gene Name: alkB homolog 8, tRNA methyltransferase;
  Uniprot ID:  Q96BT7;
  ENSP ID: ENSP00000391225
MDSNHQSNYKLSKTEKKFLRKQIKAKHTLLRHEGIETVSYATQSLVVANGGLGNGVSRNQLLPVLEKCGLVDALLMPPNKPYSFARYRTTEESKRAYVTLNGKEVVDDLGQKITLYLNFVEKVQWKELRPQALPPGLMVVEEIISSEEEKMLLESVDWTEDTDNQNSQKSLKHRRVKHFGYEFHYENNNVDKDKPLSGGLPDICESFLEKWLRKAEKNLEVGIH

SEQ ID NO: 4181 - protein, 667 aa, Homo sapiens
  Payload ID: 940;
  Gene Symbol: ALKBH8;
  Gene Name: alkB homolog 8, tRNA methyltransferase;
  Uniprot ID:  Q96BT7;
  ENSP ID: ENSP00000397673
MFAMDSNHQSNYKLSKTEKKFLRKQIKAKHTLLRHEGIETVSYATQSLVVANGGLGNGVSRNQLLPVLEKCGLVDALLMPPNKPYSFARYRTTEESKRAYVTLNGKEVVDDLGQKITLYLNFVEKVQWKELRPQALPPGLMVVEEIISSEEEKMLLESVDWTEDTDNQNSQKSLKHRRVKHFGYEFHYENNNVDKDKPLSGGLPDICESFLEKWLRKGYIKHKPDQMTINQYEPGQGIPAHIDTHSAFEDEIVSLSLGSEIVMDFKHPDGIAVPVMLPRRSLLVMTGESRYLWTHGITCRKFDTVQASESLKSGIITSDVGDLTLSKRGLRTSFTFRKVRQTPCNCSYPLVCDSQRKETPPSFPESDKEASRLEQEYVHQVYEEIAGHFSSTRHTPWPHIVEFLKALPSGSIVADIGCGNGKYLGINKELYMIGCDRSQNLVDICRERQFQAFVCDALAVPVRSGSCDACISIAVIHHFATAERRVAALQEIVRLLRPGGKALIYVWAMEQEYNKQKSKYLRGNRNSQGKKEEMNSDTSVQRSLVEQMRDMGSRDSASSVPRINDSQEGGCNSRQVSNSKLPVHVNRTSFYSQDVLVPWHLKGNPDKGKPVEPFGPIGSQDPSPVFHRYYHVFREGELEGACRTVSDVRILQSYYDQGNWCVILQKA

SEQ ID NO: 4182 - protein, 664 aa, Homo sapiens; identical to SEQ ID NO: 4178
  Payload ID: 940;
  Gene Symbol: ALKBH8;
  Gene Name: alkB homolog 8, tRNA methyltransferase;
  Uniprot ID:  Q96BT7;
  ENSP ID: ENSP00000415885

SEQ ID NO: 4183 - protein, 445 aa, Homo sapiens
  Payload ID: 941;
  Gene Symbol: AGMO;
  Gene Name: alkylglycerol monooxygenase;
  Uniprot ID:  Q6ZNB7;
  ENSP ID: ENSP00000341662
MKNPEAQQDVSVSQGFRMLFYTMKPSETSFQTLEEVPDYVKKATPFFISLMLLELVVSWILKGKPPGRLDDALTSISAGVLSRLPSLFFRSIELTSYIYIWENYRLFNLPWDSPWTWYSAFLGVDFGYYWFHRMAHEVNIMWAGHQTHHSSEDYNLSTALRQSVLQIYTSWIFYSPLALFIPPSVYAVHLQFNLLYQFWIHTEVINNLGPLELILNTPSHHRVHHGRNRYCIDKNYAGVLIIWDKIFGTFEAENEKVVYGLTHPINTFEPIKVQFHHLFSIWTTFWATPGFFNKFSVIFKGPGWGPGKPRLGLSEEIPEVTGKEVPFSSSSSQLLKIYTVVQFALMLAFYEETFADTAALSQVTLLLRVCFIILTLTSIGFLLDQRPKAAIMETLRCLMFLMLYRFGHLKPLVPSLSSAFEIVFSICIAFWGVRSMKQLTSHPWK

SEQ ID NO: 4184 - protein, 87 aa, Homo sapiens
  Payload ID: 941;
  Gene Symbol: AGMO;
  Gene Name: alkylglycerol monooxygenase;
  ENSP ID: ENSP00000385742
  MOD_RES (1)..(1): Any amino acid
XFIILTLTSIGFLLDQRPKAAIMETLRCLMFLMLYRFGHLKPLVPSLSSAFESYSVISEIGLQAKENFGELLSLSDCLTAGNHPKVH

SEQ ID NO: 4185 - protein, 74 aa, Homo sapiens
  Payload ID: 941;
  Gene Symbol: AGMO;
  Gene Name: alkylglycerol monooxygenase;
  ENSP ID: ENSP00000394412
ALSQVTLLLRVCFIILTLTSIGFLLDQRPKAAIMETLRCLMFLMLYRFGHLKPLVPSLSSAFEETPYLSSNSAI

SEQ ID NO: 4186 - protein, 658 aa, Homo sapiens
  Payload ID: 942;
  Gene Symbol: AGPS;
  Gene Name: alkylglycerone phosphate synthase;
  Uniprot ID:  O00116;
  ENSP ID: ENSP00000264167
MAEAAAAAGGTGLGAGASYGSAADRDRDPDPDRAGRRLRVLSGHLLGRPREALSTNECKARRAASAATAAPTATPAAQESGTIPKKRQEVMKWNGWGYNDSKFIFNKKGQIELTGKRYPLSGMGLPTFKEWIQNTLGVNVEHKTTSKASLNPSDTPPSVVNEDFLHDLKETNISYSQEADDRVFRAHGHCLHEIFLLREGMFERIPDIVLWPTCHDDVVKIVNLACKYNLCIIPIGGGTSVSYGLMCPADETRTIISLDTSQMNRILWVDENNLTAHVEAGITGQELERQLKESGYCTGHEPDSLEFSTVGGWVSTRASGMKKNIYGNIEDLVVHIKMVTPRGIIEKSCQGPRMSTGPDIHHFIMGSEGTLGVITEATIKIRPVPEYQKYGSVAFPNFEQGVACLREIAKQRCAPASIRLMDNKQFQFGHALKPQVSSIFTSFLDGLKKFYITKFKGFDPNQLSVATLLFEGDREKVLQHEKQVYDIAAKFGGLAAGEDNGQRGYLLTYVIAYIRDLALEYYVLGESFETSAPWDRVVDLCRNVKERITRECKEKGVQFAPFSTCRVTQTYDAGACIYFYFAFNYRGISDPLTVFEQTEAAAREEILANGGSLSHHHGVGKLRKQWLKESISDVGFGMLKSVKEYVDPNNIFGNRNLL

SEQ ID NO: 4187 - protein, 189 aa, Homo sapiens
  Payload ID: 942;
  Gene Symbol: AGPS;
  Gene Name: alkylglycerone phosphate synthase;
  ENSP ID: ENSP00000386688
MAEAAAAAGGTGLGAGASYGSAADRDRDPDPDRAGRRLRVLSGHLLGRPREALSTNECKARRAASAATAAPTATPAAQESGTIPKKRQEVMKWNGWGYNDSKFIFNKKGQIELTGKRGISDPLTVFEQTEAAAREEILANGGSLSHHHGVGKLRKQWLKESISDVGFGMLKSVKEYVDPNNIFGNRNLL

SEQ ID NO: 4188 - protein, 391 aa, Homo sapiens
  Payload ID: 943;
  Gene Symbol: ALLC;
  Gene Name: allantoicase;
  ENSP ID: ENSP00000252505
MDMASESVGGKILFATDDFFAPAENLIKSDSPCFKEHEYTEFGKWMDGWETRRKRIPGHDWCVLRLGIQGVIRGFDVDVSYFTGDYAPRVSIQAANLEEDKLPEIPERGTRTGAAATPEEFEAIAELKSDDWSYLVPMTELKPGNPASGHNYFLVNSQQRWTHIRLNIFPDGGIARLRVFGTGQKDWTATDPKEPADLVAIAFGGVCVGFSNAKFGHPNNIIGVGGAKSMADGWETARRLDRPPILENDENGILLVPGCEWAVFRLAHPGVITRIEIDTKYFEGNAPDSCKVDGCILTTQEEEAVIRQKWILPAHKWKPLLPVTKLSPNQSHLFDSLTLELQDVITHARLTIVPDGGVSRLRLRGFPSSICLLRPREKPMLKFSVSFKANP

SEQ ID NO: 4189 - protein, 161 aa, Homo sapiens
  Payload ID: 944;
  Gene Symbol: AIF1;
  Gene Name: allograft inflammatory  factor 1;
  ENSP ID: ENSP00000338776
GRKASEKTGGREGEPADRGLQLGGKAFGLLKAQQEERLDEINKQFLDDPKYSSDEDLPSKLEGFKEKYMEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 4190 - protein, 93 aa, Homo sapiens
  Payload ID: 944;
  Gene Symbol: AIF1;
  Gene Name: allograft inflammatory  factor 1;
  Uniprot ID:  P55008;
  ENSP ID: ENSP00000365217
MEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 4191 - protein, 147 aa, Homo sapiens
  Payload ID: 944;
  Gene Symbol: AIF1;
  Gene Name: allograft inflammatory  factor 1;
  Uniprot ID:  P55008;
  ENSP ID: ENSP00000365227
MSQTRDLQGGKAFGLLKAQQEERLDEINKQFLDDPKYSSDEDLPSKLEGFKEKYMEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 4192 - protein, 93 aa, Homo sapiens; identical to SEQ ID NO: 4190
  Payload ID: 944;
  Gene Symbol: AIF1;
  Gene Name: allograft inflammatory  factor 1;
  Uniprot ID:  P55008;
  ENSP ID: ENSP00000372965

SEQ ID NO: 4193 - protein, 147 aa, Homo sapiens; identical to SEQ ID NO: 4191
  Payload ID: 944;
  Gene Symbol: AIF1;
  Gene Name: allograft inflammatory  factor 1;
  Uniprot ID:  P55008;
  ENSP ID: ENSP00000372966

SEQ ID NO: 4194 - protein, 147 aa, Homo sapiens; identical to SEQ ID NO: 4191
  Payload ID: 944;
  Gene Symbol: AIF1;
  Gene Name: allograft inflammatory  factor 1;
  Uniprot ID:  P55008;
  ENSP ID: ENSP00000391720

SEQ ID NO: 4195 - protein, 161 aa, Homo sapiens; identical to SEQ ID NO: 4189
  Payload ID: 944;
  Gene Symbol: AIF1;
  Gene Name: allograft inflammatory  factor 1;
  ENSP ID: ENSP00000393114

SEQ ID NO: 4196 - protein, 161 aa, Homo sapiens; identical to SEQ ID NO: 4189
  Payload ID: 944;
  Gene Symbol: AIF1;
  Gene Name: allograft inflammatory  factor 1;
  ENSP ID: ENSP00000393996

SEQ ID NO: 4197 - protein, 161 aa, Homo sapiens; identical to SEQ ID NO: 4189
  Payload ID: 944;
  Gene Symbol: AIF1;
  Gene Name: allograft inflammatory  factor 1;
  ENSP ID: ENSP00000394278

SEQ ID NO: 4198 - protein, 147 aa, Homo sapiens; identical to SEQ ID NO: 4191
  Payload ID: 944;
  Gene Symbol: AIF1;
  Gene Name: allograft inflammatory  factor 1;
  Uniprot ID:  P55008;
  ENSP ID: ENSP00000397842

SEQ ID NO: 4199 - protein, 147 aa, Homo sapiens; identical to SEQ ID NO: 4191
  Payload ID: 944;
  Gene Symbol: AIF1;
  Gene Name: allograft inflammatory  factor 1;
  Uniprot ID:  P55008;
  ENSP ID: ENSP00000398013

SEQ ID NO: 4200 - protein, 93 aa, Homo sapiens; identical to SEQ ID NO: 4190
  Payload ID: 944;
  Gene Symbol: AIF1;
  Gene Name: allograft inflammatory  factor 1;
  Uniprot ID:  P55008;
  ENSP ID: ENSP00000399621

SEQ ID NO: 4201 - protein, 93 aa, Homo sapiens; identical to SEQ ID NO: 4190
  Payload ID: 944;
  Gene Symbol: AIF1;
  Gene Name: allograft inflammatory  factor 1;
  Uniprot ID:  P55008;
  ENSP ID: ENSP00000399901

SEQ ID NO: 4202 - protein, 161 aa, Homo sapiens; identical to SEQ ID NO: 4189
  Payload ID: 944;
  Gene Symbol: AIF1;
  Gene Name: allograft inflammatory  factor 1;
  ENSP ID: ENSP00000400538

SEQ ID NO: 4203 - protein, 93 aa, Homo sapiens; identical to SEQ ID NO: 4190
  Payload ID: 944;
  Gene Symbol: AIF1;
  Gene Name: allograft inflammatory  factor 1;
  Uniprot ID:  P55008;
  ENSP ID: ENSP00000401433

SEQ ID NO: 4204 - protein, 93 aa, Homo sapiens; identical to SEQ ID NO: 4190
  Payload ID: 944;
  Gene Symbol: AIF1;
  Gene Name: allograft inflammatory  factor 1;
  Uniprot ID:  P55008;
  ENSP ID: ENSP00000413709

SEQ ID NO: 4205 - protein, 161 aa, Homo sapiens; identical to SEQ ID NO: 4189
  Payload ID: 944;
  Gene Symbol: AIF1;
  Gene Name: allograft inflammatory  factor 1;
  ENSP ID: ENSP00000415805

SEQ ID NO: 4206 - protein, 147 aa, Homo sapiens; identical to SEQ ID NO: 4191
  Payload ID: 944;
  Gene Symbol: AIF1;
  Gene Name: allograft inflammatory  factor 1;
  Uniprot ID:  P55008;
  ENSP ID: ENSP00000416061

SEQ ID NO: 4207 - protein, 150 aa, Homo sapiens
  Payload ID: 945;
  Gene Symbol: AIF1L;
  Gene Name: allograft inflammatory  factor 1-like;
  Uniprot ID:  Q9BQI0;
  ENSP ID: ENSP00000247291
MSGELSNRFQGGKAFGLLKARQERRLAEINREFLCDQKYSDEENLPEKLTAFKEKYMEFDLNNEGEIDLMSLKRMMEKLGVPKTHLEMKKMISEVTGGVSDTISYRDFVNMMLGKRSAVLKLVMMFEGKANESSPKPVGPPPERDIASLP

SEQ ID NO: 4208 - protein, 46 aa, Homo sapiens
  Payload ID: 945;
  Gene Symbol: AIF1L;
  Gene Name: allograft inflammatory  factor 1-like;
  ENSP ID: ENSP00000361371
MEFDLNNEGEIDLMSLKRMMEKLGVPKTHLEMKKMISEVTGGSHDV

SEQ ID NO: 4209 - protein, 97 aa, Homo sapiens
  Payload ID: 945;
  Gene Symbol: AIF1L;
  Gene Name: allograft inflammatory  factor 1-like;
  ENSP ID: ENSP00000361372
MSGELSNRFQGGKAFGLLKARQERRLAEINREFLCDQKYSDEENLPEKLTAFKEKYMEFDLNNEGEIDLMSLKRMMEKLGVPKTHLEMKKMISEGGY

SEQ ID NO: 4210 - protein, 102 aa, Homo sapiens
  Payload ID: 945;
  Gene Symbol: AIF1L;
  Gene Name: allograft inflammatory  factor 1-like;
  Uniprot ID:  Q9BQI0;
  ENSP ID: ENSP00000361374
MSGELSNRFQGGKAFGLLKARQERRLAEINREFLCDQKYSDEENLPEKLTAFKEKYMEFDLNNEGEIDLMSLKRMMEKLGVPKTHLEMKKMISEVTGGSHDV

SEQ ID NO: 4211 - protein, 94 aa, Homo sapiens
  Payload ID: 945;
  Gene Symbol: AIF1L;
  Gene Name: allograft inflammatory  factor 1-like;
  ENSP ID: ENSP00000361375
MEFDLNNEGEIDLMSLKRMMEKLGVPKTHLEMKKMISEVTGGVSDTISYRDFVNMMLGKRSAVLKLVMMFEGKANESSPKPVGPPPERDIASLP

SEQ ID NO: 4212 - protein, 142 aa, Homo sapiens
  Payload ID: 945;
  Gene Symbol: AIF1L;
  Gene Name: allograft inflammatory  factor 1-like;
  Uniprot ID:  Q9BQI0;
  ENSP ID: ENSP00000361376
MSGELSNRFQGGKAFGLLKARQERRLAEINREFLCDQKYSDEENLPEKLTAFKEKYMEFDLMSLKRMMEKLGVPKTHLEMKKMISEVTGGVSDTISYRDFVNMMLGKRSAVLKLVMMFEGKANESSPKPVGPPPERDIASLP

SEQ ID NO: 4213 - protein, 176 aa, Homo sapiens
  Payload ID: 945;
  Gene Symbol: AIF1L;
  Gene Name: allograft inflammatory  factor 1-like;
  Uniprot ID:  Q9BQI0;
  ENSP ID: ENSP00000361383
MSGELSNRFQGGKAFGLLKARQERRLAEINRYCAGREPQLQRISCSQHSCLLALLFQEFLCDQKYSDEENLPEKLTAFKEKYMEFDLNNEGEIDLMSLKRMMEKLGVPKTHLEMKKMISEVTGGVSDTISYRDFVNMMLGKRSAVLKLVMMFEGKANESSPKPVGPPPERDIASLP

SEQ ID NO: 4214 - protein, 42 aa, Homo sapiens
  Payload ID: 945;
  Gene Symbol: AIF1L;
  Gene Name: allograft inflammatory  factor 1-like;
  ENSP ID: ENSP00000361388
MSGELSNRFQGRLFVSSRREGVRLAQSPAGEEAGRDQPGVSV

SEQ ID NO: 4215 - protein, 284 aa, Homo sapiens
  Payload ID: 946;
  Gene Symbol: ATRAID;
  Gene Name: all-trans retinoic acid-induced differentiation factor;
  Uniprot ID:  Q6UW56;
  ENSP ID: ENSP00000369518
MKTSAELHEQEKPPSSPRATGPGRLGHARGRGPDALRGGAAGPGRASSGAPRERKMAPHDPGSLTTLVPWAAALLLALGVERALALPEICTQCPGSVQNLSKVAFYCKTTRELMLHARCCLNQKGTILGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQGSFSLLMFFGILGATTLSVSILLWATQRRKAKTS

SEQ ID NO: 4216 - protein, 171 aa, Homo sapiens
  Payload ID: 946;
  Gene Symbol: ATRAID;
  Gene Name: all-trans retinoic acid-induced differentiation factor;
  Uniprot ID:  Q6UW56;
  ENSP ID: ENSP00000384033
MLHARCCLNQKGTILGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQGSFSLLMFFGILGATTLSVSILLWATQRRKAKTS

SEQ ID NO: 4217 - protein, 75 aa, Homo sapiens
  Payload ID: 946;
  Gene Symbol: ATRAID;
  Gene Name: all-trans retinoic acid-induced differentiation factor;
  ENSP ID: ENSP00000397319
MLHARCCLNQKGTILGLDLQNCSLEDPGPNFHQAHTTVIIDLQANPLKGDLANTFRGFTQLQTLILPQHVNCPGG

SEQ ID NO: 4218 - protein, 229 aa, Homo sapiens
  Payload ID: 946;
  Gene Symbol: ATRAID;
  Gene Name: all-trans retinoic acid-induced differentiation factor;
  Uniprot ID:  Q6UW56;
  ENSP ID: ENSP00000476080
MAPHDPGSLTTLVPWAAALLLALGVERALALPEICTQCPGSVQNLSKVAFYCKTTRELMLHARCCLNQKGTILGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQGSFSLLMFFGILGATTLSVSILLWATQRRKAKTS

SEQ ID NO: 4219 - protein, 284 aa, Homo sapiens; identical to SEQ ID NO: 4215
  Payload ID: 946;
  Gene Symbol: ATRAID;
  Gene Name: all-trans retinoic acid-induced differentiation factor;
  Uniprot ID:  Q6UW56;
  ENSP ID: ENSP00000484228

SEQ ID NO: 4220 - protein, 340 aa, Homo sapiens
  Payload ID: 947;
  Gene Symbol: A3GALT2;
  Gene Name: alpha 1,3-galactosyltransferase 2;
  ENSP ID: ENSP00000475261
MALKEGLRAWKRIFWRQILLTLGLLGLFLYGLPKFRHLEALIPMGVCPSATMSQLRDNFTGALRPWARPEVLTCTPWGAPIIWDGSFDPDVAKQEARQQNLTIGLTIFAVGRYLEKYLERFLETAEQHFMAGQSVMYYVFTELPGAVPRVALGPGRRLPVERVARERRWQDVSMARMRTLHAALGGLPGREAHFMFCMDVDQHFSGTFGPEALAESVAQLHSWHYHWPSWLLPFERDAHSAAAMAWGQGDFYNHAAVFGGSVAALRGLTAHCAGGLDWDRARGLEARWHDESHLNKFFWLHKPAKVLSPEFCWSPDIGPRAEIRRPRLLWAPKGYRLLRN

SEQ ID NO: 4221 - protein, 353 aa, Homo sapiens
  Payload ID: 948;
  Gene Symbol: A4GALT;
  Gene Name: alpha 1,4-galactosyltransferase;
  Uniprot ID:  Q9NPC4;
  ENSP ID: ENSP00000249005
MSKPPDLLLRLLRGAPRQRVCTLFIIGFKFTFFVSIMIYWHVVGEPKEKGQLYNLPAEIPCPTLTPPTPPSHGPTPGNIFFLETSDRTNPNFLFMCSVESAARTHPESHVLVLMKGLPGGNASLPRHLGISLLSCFPNVQMLPLDLRELFRDTPLADWYAAVQGRWEPYLLPVLSDASRIALMWKFGGIYLDTDFIVLKNLRNLTNVLGTQSRYVLNGAFLAFERRHEFMALCMRDFVDHYNGWIWGHQGPQLLTRVFKKWCSIRSLAESRACRGVTTLPPEAFYPIPWQDWKKYFEDINPEELPRLLSATYAVHVWNKKSQGTRFEATSRALLAQLHARYCPTTHEAMKMYL

SEQ ID NO: 4222 - protein, 353 aa, Homo sapiens; identical to SEQ ID NO: 4221
  Payload ID: 948;
  Gene Symbol: A4GALT;
  Gene Name: alpha 1,4-galactosyltransferase;
  Uniprot ID:  Q9NPC4;
  ENSP ID: ENSP00000370678

SEQ ID NO: 4223 - protein, 353 aa, Homo sapiens; identical to SEQ ID NO: 4221
  Payload ID: 948;
  Gene Symbol: A4GALT;
  Gene Name: alpha 1,4-galactosyltransferase;
  Uniprot ID:  Q9NPC4;
  ENSP ID: ENSP00000384794

SEQ ID NO: 4224 - protein, 315 aa, Homo sapiens
  Payload ID: 949;
  Gene Symbol: AAGAB;
  Gene Name: alpha- and gamma-adaptin binding prt;
  Uniprot ID:  Q6PD74;
  ENSP ID: ENSP00000261880
MAAGVPCALVTSCSSVFSGDQLVQHILGTEDLIVEVTSNDAVRFYPWTIDNKYYSADINLCVVPNKFLVTAEIAESVQAFVVYFDSTQKSGLDSVSSWLPLAKAWLPEVMILVCDRVSEDGINRQKAQEWCIKHGFELVELSPEELPEEDDDFPESTGVKRIVQALNANVWSNVVMKNDRNQGFSLLNSLTGTNHSIGSADPCHPEQPHLPAADSTESLSDHRGGASNTTDAQVDSIVDPMLDLDIQELASLTTGGGDVENFERLFSKLKEMKDKAATLPHEQRKVHAEKVAKAFWMAIGGDRDEIEGLSSDEEH

SEQ ID NO: 4225 - protein, 206 aa, Homo sapiens
  Payload ID: 949;
  Gene Symbol: AAGAB;
  Gene Name: alpha- and gamma-adaptin binding prt;
  Uniprot ID:  Q6PD74;
  ENSP ID: ENSP00000440735
MILVCDRVSEDGINRQKAQEWCIKHGFELVELSPEELPEEDDDFPESTGVKRIVQALNANVWSNVVMKNDRNQGFSLLNSLTGTNHSIGSADPCHPEQPHLPAADSTESLSDHRGGASNTTDAQVDSIVDPMLDLDIQELASLTTGGGDVENFERLFSKLKEMKDKAATLPHEQRKVHAEKVAKAFWMAIGGDRDEIEGLSSDEEH

SEQ ID NO: 4226 - protein, 58 aa, Homo sapiens
  Payload ID: 949;
  Gene Symbol: AAGAB;
  Gene Name: alpha- and gamma-adaptin binding prt;
  ENSP ID: ENSP00000453059
MILVCDRVSEDGINRQKAQEWCIKHGFELVELSPEELPEEDDDFPESTGVKRIVQALN

SEQ ID NO: 4227 - protein, 206 aa, Homo sapiens; identical to SEQ ID NO: 4225
  Payload ID: 949;
  Gene Symbol: AAGAB;
  Gene Name: alpha- and gamma-adaptin binding prt;
  Uniprot ID:  Q6PD74;
  ENSP ID: ENSP00000453263

SEQ ID NO: 4228 - protein, 102 aa, Homo sapiens
  Payload ID: 950;
  Gene Symbol: AHSP;
  Gene Name: alpha hemoglobin stabilizing prt;
  Uniprot ID:  Q9NZD4;
  ENSP ID: ENSP00000307199
MALLKANKDLISAGLKEFSVLLNQQVFNDPLVSEEDMVTVVEDWMNFYINYYRQQVTGEPQERDKALQELRQELNTLANPFLAKYRDFLKSHELPSHPPPSS

SEQ ID NO: 4229 - protein, 57 aa, Homo sapiens
  Payload ID: 950;
  Gene Symbol: AHSP;
  Gene Name: alpha hemoglobin stabilizing prt;
  ENSP ID: ENSP00000456748
MALLKANKDLISAGLKEFSVLLNQQVFNDPLVSEEDMVTVVEDWMNFYINYYRQQVT

SEQ ID NO: 4230 - protein, 2492 aa, Homo sapiens
  Payload ID: 951;
  Gene Symbol: ATRX;
  Gene Name: alpha thalassemia/mental retardation syndrome X-linked;
  Uniprot ID:  P46100;
  ENSP ID: ENSP00000362441
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEESFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 4231 - protein, 2454 aa, Homo sapiens
  Payload ID: 951;
  Gene Symbol: ATRX;
  Gene Name: alpha thalassemia/mental retardation syndrome X-linked;
  Uniprot ID:  P46100;
  ENSP ID: ENSP00000378967
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEESFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 4232 - protein, 198 aa, Homo sapiens
  Payload ID: 951;
  Gene Symbol: ATRX;
  Gene Name: alpha thalassemia/mental retardation syndrome X-linked;
  ENSP ID: ENSP00000383663
EDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTVLHLNKMGMLKSIKYF

SEQ ID NO: 4233 - protein, 164 aa, Homo sapiens
  Payload ID: 951;
  Gene Symbol: ATRX;
  Gene Name: alpha thalassemia/mental retardation syndrome X-linked;
  ENSP ID: ENSP00000480196
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGVLW

SEQ ID NO: 4234 - protein, 198 aa, Homo sapiens
  Payload ID: 951;
  Gene Symbol: ATRX;
  Gene Name: alpha thalassemia/mental retardation syndrome X-linked;
  ENSP ID: ENSP00000485099
  MOD_RES (1)..(1): Any amino acid
XEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDE

SEQ ID NO: 4235 - protein, 108 aa, Homo sapiens
  Payload ID: 951;
  Gene Symbol: ATRX;
  Gene Name: alpha thalassemia/mental retardation syndrome X-linked;
  ENSP ID: ENSP00000485100
MMENSKEEGTSSSEKSKSSGSSRSKRKPSIVTKYVESDDEKPLDDETVNEDASNENSENDITMQSLPKEDGLHGIVSCTACGQQVNHFQKDSIYRHPSLQVLICKNCF

SEQ ID NO: 4236 - protein, 1351 aa, Homo sapiens
  Payload ID: 951;
  Gene Symbol: ATRX;
  Gene Name: alpha thalassemia/mental retardation syndrome X-linked;
  ENSP ID: ENSP00000485103
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEESFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSY

SEQ ID NO: 4237 - protein, 528 aa, Homo sapiens
  Payload ID: 951;
  Gene Symbol: ATRX;
  Gene Name: alpha thalassemia/mental retardation syndrome X-linked;
  ENSP ID: ENSP00000485127
MMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVT

SEQ ID NO: 4238 - protein, 66 aa, Homo sapiens
  Payload ID: 951;
  Gene Symbol: ATRX;
  Gene Name: alpha thalassemia/mental retardation syndrome X-linked;
  ENSP ID: ENSP00000485183
  MOD_RES (1)..(1): Any amino acid
XENDDSKSPGKGRKKIRKILKDDKLRTETQNALKEEEERRKRIAEREREREKLREVTNFFLLLFLL

SEQ ID NO: 4239 - protein, 954 aa, Homo sapiens
  Payload ID: 951;
  Gene Symbol: ATRX;
  Gene Name: alpha thalassemia/mental retardation syndrome X-linked;
  ENSP ID: ENSP00000485253
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEESFTSLEVRKVAETKEKSKHLKTKTCKKVQDGLSDIAEKFLKKDQSDETSEDDKK

SEQ ID NO: 4240 - protein, 175 aa, Homo sapiens
  Payload ID: 951;
  Gene Symbol: ATRX;
  Gene Name: alpha thalassemia/mental retardation syndrome X-linked;
  ENSP ID: ENSP00000485274
  MOD_RES (1)..(1): Any amino acid
XRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEENIYKVLTICPDIRRELISLNGKLKKVKLLLLLIQAAQLQTGTKILLQMLMLRF

SEQ ID NO: 4241 - protein, 293 aa, Homo sapiens
  Payload ID: 951;
  Gene Symbol: ATRX;
  Gene Name: alpha thalassemia/mental retardation syndrome X-linked;
  ENSP ID: ENSP00000485408
TTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRYDSICKDFKKIITHPRHGHKQQQRNSKQVVKTRSACLRKTRSQSSCKFERKARKWAKTQKP

SEQ ID NO: 4242 - protein, 47 aa, Homo sapiens
  Payload ID: 951;
  Gene Symbol: ATRX;
  Gene Name: alpha thalassemia/mental retardation syndrome X-linked;
  ENSP ID: ENSP00000485587
MNQNTDKISGSGSNSDMMENSKEEGTSSSEKSKSSGSSRSKRKPSIV

SEQ ID NO: 4243 - protein, 300 aa, Homo sapiens
  Payload ID: 952;
  Gene Symbol: ATAT1;
  Gene Name: alpha tubulin acetyltransferase 1;
  Uniprot ID:  Q5SQI0;
  ENSP ID: ENSP00000324222
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHPPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTR

SEQ ID NO: 4244 - protein, 310 aa, Homo sapiens
  Payload ID: 952;
  Gene Symbol: ATAT1;
  Gene Name: alpha tubulin acetyltransferase 1;
  Uniprot ID:  Q5SQI0;
  ENSP ID: ENSP00000324459
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHPPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTSSLPRSEESRY

SEQ ID NO: 4245 - protein, 409 aa, Homo sapiens
  Payload ID: 952;
  Gene Symbol: ATAT1;
  Gene Name: alpha tubulin acetyltransferase 1;
  Uniprot ID:  Q5SQI0;
  ENSP ID: ENSP00000327832
MWLTWPFCFLTITLREEGVCHLESVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTRGTPPGLVAQSCCYSRHGGVNSSSPNTGNQDSKQGEQETKNRSASEEQALSQDGSGEKPMHTAPPQAPAPPAQSWTVGGDILNARFIRNLQERRSTRPW

SEQ ID NO: 4246 - protein, 333 aa, Homo sapiens
  Payload ID: 952;
  Gene Symbol: ATAT1;
  Gene Name: alpha tubulin acetyltransferase 1;
  Uniprot ID:  Q5SQI0;
  ENSP ID: ENSP00000332374
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTSSLPRSEESRY

SEQ ID NO: 4247 - protein, 323 aa, Homo sapiens
  Payload ID: 952;
  Gene Symbol: ATAT1;
  Gene Name: alpha tubulin acetyltransferase 1;
  Uniprot ID:  Q5SQI0;
  ENSP ID: ENSP00000365666
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTR

SEQ ID NO: 4248 - protein, 421 aa, Homo sapiens
  Payload ID: 952;
  Gene Symbol: ATAT1;
  Gene Name: alpha tubulin acetyltransferase 1;
  Uniprot ID:  Q5SQI0;
  ENSP ID: ENSP00000365668
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTRGTPPGLVAQSCCYSRHGGVNSSSPNTGNQDSKQGEQETKNRSASEEQALSQDGSGEKPMHTAPPQAPAPPAQSWTVGGDILNARFIRNLQERRSTRPW

SEQ ID NO: 4249 - protein, 409 aa, Homo sapiens; identical to SEQ ID NO: 4245
  Payload ID: 952;
  Gene Symbol: ATAT1;
  Gene Name: alpha tubulin acetyltransferase 1;
  Uniprot ID:  Q5SQI0;
  ENSP ID: ENSP00000373076

SEQ ID NO: 4250 - protein, 333 aa, Homo sapiens; identical to SEQ ID NO: 4246
  Payload ID: 952;
  Gene Symbol: ATAT1;
  Gene Name: alpha tubulin acetyltransferase 1;
  Uniprot ID:  Q5SQI0;
  ENSP ID: ENSP00000373077

SEQ ID NO: 4251 - protein, 300 aa, Homo sapiens; identical to SEQ ID NO: 4243
  Payload ID: 952;
  Gene Symbol: ATAT1;
  Gene Name: alpha tubulin acetyltransferase 1;
  Uniprot ID:  Q5SQI0;
  ENSP ID: ENSP00000373078

SEQ ID NO: 4252 - protein, 421 aa, Homo sapiens; identical to SEQ ID NO: 4248
  Payload ID: 952;
  Gene Symbol: ATAT1;
  Gene Name: alpha tubulin acetyltransferase 1;
  Uniprot ID:  Q5SQI0;
  ENSP ID: ENSP00000373079

SEQ ID NO: 4253 - protein, 323 aa, Homo sapiens; identical to SEQ ID NO: 4247
  Payload ID: 952;
  Gene Symbol: ATAT1;
  Gene Name: alpha tubulin acetyltransferase 1;
  Uniprot ID:  Q5SQI0;
  ENSP ID: ENSP00000383419

SEQ ID NO: 4254 - protein, 310 aa, Homo sapiens; identical to SEQ ID NO: 4244
  Payload ID: 952;
  Gene Symbol: ATAT1;
  Gene Name: alpha tubulin acetyltransferase 1;
  Uniprot ID:  Q5SQI0;
  ENSP ID: ENSP00000383420

SEQ ID NO: 4255 - protein, 323 aa, Homo sapiens; identical to SEQ ID NO: 4247
  Payload ID: 952;
  Gene Symbol: ATAT1;
  Gene Name: alpha tubulin acetyltransferase 1;
  Uniprot ID:  Q5SQI0;
  ENSP ID: ENSP00000388171

SEQ ID NO: 4256 - protein, 323 aa, Homo sapiens; identical to SEQ ID NO: 4247
  Payload ID: 952;
  Gene Symbol: ATAT1;
  Gene Name: alpha tubulin acetyltransferase 1;
  Uniprot ID:  Q5SQI0;
  ENSP ID: ENSP00000388617

SEQ ID NO: 4257 - protein, 409 aa, Homo sapiens; identical to SEQ ID NO: 4245
  Payload ID: 952;
  Gene Symbol: ATAT1;
  Gene Name: alpha tubulin acetyltransferase 1;
  Uniprot ID:  Q5SQI0;
  ENSP ID: ENSP00000389129

SEQ ID NO: 4258 - protein, 409 aa, Homo sapiens; identical to SEQ ID NO: 4245
  Payload ID: 952;
  Gene Symbol: ATAT1;
  Gene Name: alpha tubulin acetyltransferase 1;
  Uniprot ID:  Q5SQI0;
  ENSP ID: ENSP00000391244

SEQ ID NO: 4259 - protein, 323 aa, Homo sapiens; identical to SEQ ID NO: 4247
  Payload ID: 952;
  Gene Symbol: ATAT1;
  Gene Name: alpha tubulin acetyltransferase 1;
  Uniprot ID:  Q5SQI0;
  ENSP ID: ENSP00000393269

SEQ ID NO: 4260 - protein, 300 aa, Homo sapiens; identical to SEQ ID NO: 4243
  Payload ID: 952;
  Gene Symbol: ATAT1;
  Gene Name: alpha tubulin acetyltransferase 1;
  Uniprot ID:  Q5SQI0;
  ENSP ID: ENSP00000393868

SEQ ID NO: 4261 - protein, 333 aa, Homo sapiens; identical to SEQ ID NO: 4246
  Payload ID: 952;
  Gene Symbol: ATAT1;
  Gene Name: alpha tubulin acetyltransferase 1;
  Uniprot ID:  Q5SQI0;
  ENSP ID: ENSP00000394357

SEQ ID NO: 4262 - protein, 421 aa, Homo sapiens; identical to SEQ ID NO: 4248
  Payload ID: 952;
  Gene Symbol: ATAT1;
  Gene Name: alpha tubulin acetyltransferase 1;
  Uniprot ID:  Q5SQI0;
  ENSP ID: ENSP00000394914

SEQ ID NO: 4263 - protein, 409 aa, Homo sapiens; identical to SEQ ID NO: 4245
  Payload ID: 952;
  Gene Symbol: ATAT1;
  Gene Name: alpha tubulin acetyltransferase 1;
  Uniprot ID:  Q5SQI0;
  ENSP ID: ENSP00000398374

SEQ ID NO: 4264 - protein, 421 aa, Homo sapiens; identical to SEQ ID NO: 4248
  Payload ID: 952;
  Gene Symbol: ATAT1;
  Gene Name: alpha tubulin acetyltransferase 1;
  Uniprot ID:  Q5SQI0;
  ENSP ID: ENSP00000398422

SEQ ID NO: 4265 - protein, 333 aa, Homo sapiens; identical to SEQ ID NO: 4246
  Payload ID: 952;
  Gene Symbol: ATAT1;
  Gene Name: alpha tubulin acetyltransferase 1;
  Uniprot ID:  Q5SQI0;
  ENSP ID: ENSP00000399452

SEQ ID NO: 4266 - protein, 333 aa, Homo sapiens; identical to SEQ ID NO: 4246
  Payload ID: 952;
  Gene Symbol: ATAT1;
  Gene Name: alpha tubulin acetyltransferase 1;
  Uniprot ID:  Q5SQI0;
  ENSP ID: ENSP00000399509

SEQ ID NO: 4267 - protein, 300 aa, Homo sapiens; identical to SEQ ID NO: 4243
  Payload ID: 952;
  Gene Symbol: ATAT1;
  Gene Name: alpha tubulin acetyltransferase 1;
  Uniprot ID:  Q5SQI0;
  ENSP ID: ENSP00000399529

SEQ ID NO: 4268 - protein, 300 aa, Homo sapiens; identical to SEQ ID NO: 4243
  Payload ID: 952;
  Gene Symbol: ATAT1;
  Gene Name: alpha tubulin acetyltransferase 1;
  Uniprot ID:  Q5SQI0;
  ENSP ID: ENSP00000402998

SEQ ID NO: 4269 - protein, 323 aa, Homo sapiens; identical to SEQ ID NO: 4247
  Payload ID: 952;
  Gene Symbol: ATAT1;
  Gene Name: alpha tubulin acetyltransferase 1;
  Uniprot ID:  Q5SQI0;
  ENSP ID: ENSP00000403142

SEQ ID NO: 4270 - protein, 333 aa, Homo sapiens; identical to SEQ ID NO: 4246
  Payload ID: 952;
  Gene Symbol: ATAT1;
  Gene Name: alpha tubulin acetyltransferase 1;
  Uniprot ID:  Q5SQI0;
  ENSP ID: ENSP00000405036

SEQ ID NO: 4271 - protein, 300 aa, Homo sapiens; identical to SEQ ID NO: 4243
  Payload ID: 952;
  Gene Symbol: ATAT1;
  Gene Name: alpha tubulin acetyltransferase 1;
  Uniprot ID:  Q5SQI0;
  ENSP ID: ENSP00000405656

SEQ ID NO: 4272 - protein, 310 aa, Homo sapiens; identical to SEQ ID NO: 4244
  Payload ID: 952;
  Gene Symbol: ATAT1;
  Gene Name: alpha tubulin acetyltransferase 1;
  Uniprot ID:  Q5SQI0;
  ENSP ID: ENSP00000406071

SEQ ID NO: 4273 - protein, 333 aa, Homo sapiens; identical to SEQ ID NO: 4246
  Payload ID: 952;
  Gene Symbol: ATAT1;
  Gene Name: alpha tubulin acetyltransferase 1;
  Uniprot ID:  Q5SQI0;
  ENSP ID: ENSP00000406421

SEQ ID NO: 4274 - protein, 421 aa, Homo sapiens; identical to SEQ ID NO: 4248
  Payload ID: 952;
  Gene Symbol: ATAT1;
  Gene Name: alpha tubulin acetyltransferase 1;
  Uniprot ID:  Q5SQI0;
  ENSP ID: ENSP00000409067

SEQ ID NO: 4275 - protein, 310 aa, Homo sapiens; identical to SEQ ID NO: 4244
  Payload ID: 952;
  Gene Symbol: ATAT1;
  Gene Name: alpha tubulin acetyltransferase 1;
  Uniprot ID:  Q5SQI0;
  ENSP ID: ENSP00000409296

SEQ ID NO: 4276 - protein, 310 aa, Homo sapiens; identical to SEQ ID NO: 4244
  Payload ID: 952;
  Gene Symbol: ATAT1;
  Gene Name: alpha tubulin acetyltransferase 1;
  Uniprot ID:  Q5SQI0;
  ENSP ID: ENSP00000410415

SEQ ID NO: 4277 - protein, 421 aa, Homo sapiens; identical to SEQ ID NO: 4248
  Payload ID: 952;
  Gene Symbol: ATAT1;
  Gene Name: alpha tubulin acetyltransferase 1;
  Uniprot ID:  Q5SQI0;
  ENSP ID: ENSP00000411050

SEQ ID NO: 4278 - protein, 323 aa, Homo sapiens; identical to SEQ ID NO: 4247
  Payload ID: 952;
  Gene Symbol: ATAT1;
  Gene Name: alpha tubulin acetyltransferase 1;
  Uniprot ID:  Q5SQI0;
  ENSP ID: ENSP00000411362

SEQ ID NO: 4279 - protein, 310 aa, Homo sapiens; identical to SEQ ID NO: 4244
  Payload ID: 952;
  Gene Symbol: ATAT1;
  Gene Name: alpha tubulin acetyltransferase 1;
  Uniprot ID:  Q5SQI0;
  ENSP ID: ENSP00000412198

SEQ ID NO: 4280 - protein, 409 aa, Homo sapiens; identical to SEQ ID NO: 4245
  Payload ID: 952;
  Gene Symbol: ATAT1;
  Gene Name: alpha tubulin acetyltransferase 1;
  Uniprot ID:  Q5SQI0;
  ENSP ID: ENSP00000412993

SEQ ID NO: 4281 - protein, 300 aa, Homo sapiens; identical to SEQ ID NO: 4243
  Payload ID: 952;
  Gene Symbol: ATAT1;
  Gene Name: alpha tubulin acetyltransferase 1;
  Uniprot ID:  Q5SQI0;
  ENSP ID: ENSP00000415000

SEQ ID NO: 4282 - protein, 310 aa, Homo sapiens; identical to SEQ ID NO: 4244
  Payload ID: 952;
  Gene Symbol: ATAT1;
  Gene Name: alpha tubulin acetyltransferase 1;
  Uniprot ID:  Q5SQI0;
  ENSP ID: ENSP00000415408

SEQ ID NO: 4283 - protein, 409 aa, Homo sapiens; identical to SEQ ID NO: 4245
  Payload ID: 952;
  Gene Symbol: ATAT1;
  Gene Name: alpha tubulin acetyltransferase 1;
  Uniprot ID:  Q5SQI0;
  ENSP ID: ENSP00000416925

SEQ ID NO: 4284 - protein, 421 aa, Homo sapiens; identical to SEQ ID NO: 4248
  Payload ID: 952;
  Gene Symbol: ATAT1;
  Gene Name: alpha tubulin acetyltransferase 1;
  Uniprot ID:  Q5SQI0;
  ENSP ID: ENSP00000416994

SEQ ID NO: 4285 - protein, 340 aa, Homo sapiens
  Payload ID: 953;
  Gene Symbol: A4GNT;
  Gene Name: alpha-1,4-N-acetylglucosaminyltransferase;
  Uniprot ID:  Q9UNA3;
  ENSP ID: ENSP00000236709
MRKELQLSLSVTLLLVCGFLYQFTLKSSCLFCLPSFKSHQGLEALLSHRRGIVFLETSERMEPPHLVSCSVESAAKIYPEWPVVFFMKGLTDSTPMPSNSTYPAFSFLSAIDNVFLFPLDMKRLLEDTPLFSWYNQINASAERNWLHISSDASRLAIIWKYGGIYMDTDVISIRPIPEENFLAAQASRYSSNGIFGFLPHHPFLWECMENFVEHYNSAIWGNQGPELMTRMLRVWCKLEDFQEVSDLRCLNISFLHPQRFYPISYREWRRYYEVWDTEPSFNVSYALHLWNHMNQEGRAVIRGSNTLVENLYRKHCPRTYRDLIKGPEGSVTGELGPGNK

SEQ ID NO: 4286 - protein, 495 aa, Homo sapiens
  Payload ID: 954;
  Gene Symbol: A1BG;
  Gene Name: alpha-1-B glycoprt;
  Uniprot ID:  P04217;
  ENSP ID: ENSP00000263100
MSMLVVFLLLWGVTWGPVTEAAIFYETQPSLWAESESLLKPLANVTLTCQAHLETPDFQLFKNGVAQEPVHLDSPAIKHQFLLTGDTQGRYRCRSGLSTGWTQLSKLLELTGPKSLPAPWLSMAPVSWITPGLKTTAVCRGVLRGVTFLLRREGDHEFLEVPEAQEDVEATFPVHQPGNYSCSYRTDGEGALSEPSATVTIEELAAPPPPVLMHHGESSQVLHPGNKVTLTCVAPLSGVDFQLRRGEKELLVPRSSTSPDRIFFHLNAVALGDGGHYTCRYRLHDNQNGWSGDSAPVELILSDETLPAPEFSPEPESGRALRLRCLAPLEGARFALVREDRGGRRVHRFQSPAGTEALFELHNISVADSANYSCVYVDLKPPFGGSAPSERLELHVDGPPPRPQLRATWSGAVLAGRDAVLRCEGPIPDVTFELLREGETKAVKTVRTPGAAANLELIFVGPQHAGNYRCRYRSWVPHTFESELSDPVELLVAES

SEQ ID NO: 4287 - protein, 305 aa, Homo sapiens
  Payload ID: 954;
  Gene Symbol: A1BG;
  Gene Name: alpha-1-B glycoprt;
  ENSP ID: ENSP00000470909
LTCQAHLETPDFQLFKNGVAQEPVHLDSPAIKHQFLLTGDTQGRYRCRSGLSTGWTQLSKLLELTGPKSLPAPWLSMAPVSWITPGLKTTAVCRGVLRGVTFLLRREGDHEFLEVPEAQEDVEATFPVHQPGNYSCSYRTDGEGALSEPSATVTIEELGPGPGSWPHGCLGLMVAKEFGQRMPKEWKAAPPPPVLMHHGESSQVLHPGNKVTLTCVAPLSGVDFQLRRGEKELLVPRSSTSPDRIFFHLNAVALGDGGHYTCRYRLHDNQNGWSGDSAPVELILSDETLPAPEFSPEPESGRALR

SEQ ID NO: 4288 - protein, 352 aa, Homo sapiens
  Payload ID: 955;
  Gene Symbol: AMBP;
  Gene Name: alpha-1-microglobulin/bikunin precursor;
  Uniprot ID:  P02760;
  ENSP ID: ENSP00000265132
MRSLGALLLLLSACLAVSAGPVPTPPDNIQVQENFNISRIYGKWYNLAIGSTCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 4289 - protein, 238 aa, Homo sapiens
  Payload ID: 955;
  Gene Symbol: AMBP;
  Gene Name: alpha-1-microglobulin/bikunin precursor;
  ENSP ID: ENSP00000474859
MRSLGALLLLLSACLAVSAGPVPTPPDNIQVQENFNISRIYGKWYNLAIGSTCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRVNGLEQATQAGPFMKWTKARQVPSTMLTKDTNPGLGWPLGLVLLFTPLSCSVT

SEQ ID NO: 4290 - protein, 193 aa, Homo sapiens
  Payload ID: 955;
  Gene Symbol: AMBP;
  Gene Name: alpha-1-microglobulin/bikunin precursor;
  ENSP ID: ENSP00000475149
HKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTVRGPCRAFIQLWAFDAVKGKCVLFPYGGC

SEQ ID NO: 4291 - protein, 298 aa, Homo sapiens
  Payload ID: 956;
  Gene Symbol: AZGP1;
  Gene Name: alpha-2-glycoprt 1, zinc-binding;
  Uniprot ID:  P25311;
  ENSP ID: ENSP00000292401
MVRMVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQDPPSVVVTSHQAPGEKKKLKCLAYDFYPGKIDVHWTRAGEVQEPELRGDVLHNGNGTYQSWVVVAVPPQDTAPYSCHVQHSSLAQPLVVPWEAS

SEQ ID NO: 4292 - protein, 85 aa, Homo sapiens
  Payload ID: 956;
  Gene Symbol: AZGP1;
  Gene Name: alpha-2-glycoprt 1, zinc-binding;
  ENSP ID: ENSP00000389942
  MOD_RES (1)..(1): Any amino acid
XTYIYTGLSKHVEDVPAFQALGSLNDLQFFRYNSKDRKSQPMGLWRQQKYPGPARSSLCGGHQPPGPRRKEETEVPGLRLLPREN

SEQ ID NO: 4293 - protein, 227 aa, Homo sapiens
  Payload ID: 956;
  Gene Symbol: AZGP1;
  Gene Name: alpha-2-glycoprt 1, zinc-binding;
  ENSP ID: ENSP00000396093
MVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQGTHCFLLPSTEPRIKDDLRLGAQATS

SEQ ID NO: 4294 - protein, 368 aa, Homo sapiens
  Payload ID: 957;
  Gene Symbol: AHSG;
  Gene Name: alpha-2-HS-glycoprt;
  ENSP ID: ENSP00000273784
MKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPADSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCMVFQTQPVSSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 4295 - protein, 367 aa, Homo sapiens
  Payload ID: 957;
  Gene Symbol: AHSG;
  Gene Name: alpha-2-HS-glycoprt;
  Uniprot ID:  P02765;
  ENSP ID: ENSP00000393887
MKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCMVFQTQPVSSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 4296 - protein, 1474 aa, Homo sapiens
  Payload ID: 958;
  Gene Symbol: A2M;
  Gene Name: alpha-2-macroglobulin;
  Uniprot ID:  P01023;
  ENSP ID: ENSP00000323929
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDNEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 4297 - protein, 168 aa, Homo sapiens
  Payload ID: 958;
  Gene Symbol: A2M;
  Gene Name: alpha-2-macroglobulin;
  ENSP ID: ENSP00000385710
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQ

SEQ ID NO: 4298 - protein, 73 aa, Homo sapiens
  Payload ID: 958;
  Gene Symbol: A2M;
  Gene Name: alpha-2-macroglobulin;
  ENSP ID: ENSP00000438599
NGGTLLGLKKLSFYYLIMAKGGIVRTGTHGLLVKQEDMKGHFSISIPVKSDIAPVARFTTCYQKRTSLASLGL

SEQ ID NO: 4299 - protein, 90 aa, Homo sapiens
  Payload ID: 958;
  Gene Symbol: A2M;
  Gene Name: alpha-2-macroglobulin;
  ENSP ID: ENSP00000445717
MGKNKLLHPSLVLLLLVLLPTDASVSGKPQYMVLVPSLLHTETTEKGCVLLSYLNETVTVSASLESVRGNRSLFTDLEAENDVLHCVAFA

SEQ ID NO: 4300 - protein, 1454 aa, Homo sapiens
  Payload ID: 959;
  Gene Symbol: A2ML1;
  Gene Name: alpha-2-macroglobulin-like 1;
  Uniprot ID:  A8K2U0;
  ENSP ID: ENSP00000299698
MWAQLLLGMLALSPAIAEELPNYLVTLPARLNFPSVQKVCLDLSPGYSDVKFTVTLETKDKTQKLLEYSGLKKRHLHCISFLVPPPAGGTEEVATIRVSGVGNNISFEEKKKVLIQRQGNGTFVQTDKPLYTPGQQVYFRIVTMDSNFVPVNDKYSMVELQDPNSNRIAQWLEVVPEQGIVDLSFQLAPEAMLGTYTVAVAEGKTFGTFSVEEYVLPKFKVEVVEPKELSTVQESFLVKICCRYTYGKPMLGAVQVSVCQKANTYWYREVEREQLPDKCRNLSGQTDKTGCFSAPVDMATFDLIGYAYSHQINIVATVVEEGTGVEANATQNIYISPQMGSMTFEDTSNFYHPNFPFSGKIRVRGHDDSFLKNHLVFLVIYGTNGTFNQTLVTDNNGLAPFTLETSGWNGTDVSLEGKFQMEDLVYNPEQVPRYYQNAYLHLRPFYSTTRSFLGIHRLNGPLKCGQPQEVLVDYYIDPADASPDQEISFSYYLIGKGSLVMEGQKHLNSKKKGLKASFSLSLTFTSRLAPDPSLVIYAIFPSGGVVADKIQFSVEMCFDNQVSLGFSPSQQLPGAEVELQLQAAPGSLCALRAVDESVLLLRPDRELSNRSVYGMFPFWYGHYPYQVAEYDQCPVSGPWDFPQPLIDPMPQGHSSQRSIIWRPSFSEGTDLFSFFRDVGLKILSNAKIKKPVDCSHRSPEYSTAMGAGGGHPEAFESSTPLHQAEDSQVRQYFPETWLWDLFPIGNSGKEAVHVTVPDAITEWKAMSFCTSQSRGFGLSPTVGLTAFKPFFVDLTLPYSVVRGESFRLTATIFNYLKDCIRVQTDLAKSHEYQLESWADSQTSSCLCADDAKTHHWNITAVKLGHINFTISTKILDSNEPCGGQKGFVPQKGRSDTLIKPVLVKPEGVLVEKTHSSLLCPKGKVASESVSLELPVDIVPDSTKAYVTVLGDIMGTALQNLDGLVQMPSGCGEQNMVLFAPIIYVLQYLEKAGLLTEEIRSRAVGFLEIGYQKELMYKHSNGSYSAFGERDGNGNTWLTAFVTKCFGQAQKFIFIDPKNIQDALKWMAGNQLPSGCYANVGNLLHTAMKGGVDDEVSLTAYVTAALLEMGKDVDDPMVSQGLRCLKNSATSTTNLYTQALLAYIFSLAGEMDIRNILLKQLDQQAIISGESIYWSQKPTPSSNASPWSEPAAVDVELTAYALLAQLTKPSLTQKEIAKATSIVAWLAKQHNAYGGFSSTQDTVVALQALAKYATTAYMPSEEINLVVKSTENFQRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 4301 - protein, 963 aa, Homo sapiens
  Payload ID: 959;
  Gene Symbol: A2ML1;
  Gene Name: alpha-2-macroglobulin-like 1;
  Uniprot ID:  A8K2U0;
  ENSP ID: ENSP00000438292
MLIGKGSLVMEGQKHLNSKKKGLKASFSLSLTFTSRLAPDPSLVIYAIFPSGGVVADKIQFSVEMCFDNQVSLGFSPSQQLPGAEVELQLQAAPGSLCALRAVDESVLLLRPDRELSNRSVYGMFPFWYGHYPYQVAEYDQCPVSGPWDFPQPLIDPMPQGHSSQRSIIWRPSFSEGTDLFSFFRDVGLKILSNAKIKKPVDCSHRSPEYSTAMGAGGGHPEAFESSTPLHQAEDSQVRQYFPETWLWDLFPIGNSGKEAVHVTVPDAITEWKAMSFCTSQSRGFGLSPTVGLTAFKPFFVDLTLPYSVVRGESFRLTATIFNYLKDCIRVQTDLAKSHEYQLESWADSQTSSCLCADDAKTHHWNITAVKLGHINFTISTKILDSNEPCGGQKGFVPQKGRSDTLIKPVLVKPEGVLVEKTHSSLLCPKGKVASESVSLELPVDIVPDSTKAYVTVLGDIMGTALQNLDGLVQMPSGCGEQNMVLFAPIIYVLQYLEKAGLLTEEIRSRAVGFLEIGYQKELMYKHSNGSYSAFGERDGNGNTWLTAFVTKCFGQAQKFIFIDPKNIQDALKWMAGNQLPSGCYANVGNLLHTAMKGGVDDEVSLTAYVTAALLEMGKDVDDPMVSQGLRCLKNSATSTTNLYTQALLAYIFSLAGEMDIRNILLKQLDQQAIISGESIYWSQKPTPSSNASPWSEPAAVDVELTAYALLAQLTKPSLTQKEIAKATSIVAWLAKQHNAYGGFSSTQDTVVALQALAKYATTAYMPSEEINLVVKSTENFQRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 4302 - protein, 183 aa, Homo sapiens
  Payload ID: 959;
  Gene Symbol: A2ML1;
  Gene Name: alpha-2-macroglobulin-like 1;
  ENSP ID: ENSP00000440057
MLGELIGKGSLVMEGQKHLNSKKKGLKASFSLSLTFTSRLAPDPSLVIYAIFPSGGVVADKIQFSVEMCFDNQVSLGFSPSQQLPGAEVELQLQAAPGSLCALRAVDESVLLLRPDRELSNRSVYGMFPFWYGHYPYQVAEYDQCPVSGPWDFPQPLIDPMPQGHSSQRSIIWRPSFSEGTDL

SEQ ID NO: 4303 - protein, 81 aa, Homo sapiens
  Payload ID: 959;
  Gene Symbol: A2ML1;
  Gene Name: alpha-2-macroglobulin-like 1;
  ENSP ID: ENSP00000440662
MVRNNFYAVRLLPSTCVVLSQTSNCRRSHQDPLAASCICQASGCWLIGKGSLVMEGQKHLNSKKKGLKASFSLSLTFTSRL

SEQ ID NO: 4304 - protein, 1004 aa, Homo sapiens
  Payload ID: 959;
  Gene Symbol: A2ML1;
  Gene Name: alpha-2-macroglobulin-like 1;
  ENSP ID: ENSP00000443174
SFLGIHRLNGPLKCGQPQEVLVDYYIDPADASPDQEISFSYYLIGKGSLVMEGQKHLNSKKKGLKASFSLSLTFTSRLAPDPSLVIYAIFPSGGVVADKIQFSVEMCFDNQVSLGFSPSQQLPGAEVELQLQAAPGSLCALRAVDESVLLLRPDRELSNRSVYGMFPFWYGHYPYQVAEYDQCPVSGPWDFPQPLIDPMPQGHSSQRSIIWRPSFSEGTDLFSFFRDVGLKILSNAKIKKPVDCSHRSPEYSTAMGAGGGHPEAFESSTPLHQAEDSQVRQYFPETWLWDLFPIGNSGKEAVHVTVPDAITEWKAMSFCTSQSRGFGLSPTVGLTAFKPFFVDLTLPYSVVRGESFRLTATIFNYLKDCIRVQTDLAKSHEYQLESWADSQTSSCLCADDAKTHHWNITAVKLGHINFTISTKILDSNEPCGGQKGFVPQKGRSDTLIKPVLVKPEGVLVEKTHSSLLCPKGKVASESVSLELPVDIVPDSTKAYVTVLGDIMGTALQNLDGLVQMPSGCGEQNMVLFAPIIYVLQYLEKAGLLTEEIRSRAVGFLEIGYQKELMYKHSNGSYSAFGERDGNGNTWLTAFVTKCFGQAQKFIFIDPKNIQDALKWMAGNQLPSGCYANVGNLLHTAMKGGVDDEVSLTAYVTAALLEMGKDVDDPMVSQGLRCLKNSATSTTNLYTQALLAYIFSLAGEMDIRNILLKQLDQQAIISGESIYWSQKPTPSSNASPWSEPAAVDVELTAYALLAQLTKPSLTQKEIAKATSIVAWLAKQHNAYGGFSSTQDTVVALQALAKYATTAYMPSEEINLVVKSTENFQRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 4305 - protein, 182 aa, Homo sapiens
  Payload ID: 959;
  Gene Symbol: A2ML1;
  Gene Name: alpha-2-macroglobulin-like 1;
  ENSP ID: ENSP00000445674
  MOD_RES (1)..(1): Any amino acid
XRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 4306 - protein, 173 aa, Homo sapiens
  Payload ID: 960;
  Gene Symbol:;
  Gene Name: alpha-crystallin A chain [Source:RefSeq peptide;Acc:NP_001300979];
  ENSP ID: ENSP00000482816
MDVTIQHPWFKRTLGPFYPSRLFDQFFGEGLFEYDLLPFLSSTISPYYRQSLFRTVLDSGISEVRSDRDKFVIFLDVKHFSPEDLTVKVQDDFVEIHGKHNERQDDHGYISREFHRRYRLPSNVDQSALSCSLSADGMLTFCGPKIQTGLDATHAERAIPVSREEKPTSAPSS

SEQ ID NO: 4307 - protein, 136 aa, Homo sapiens
  Payload ID: 960;
  Gene Symbol:;
  Gene Name: alpha-crystallin A chain [Source:RefSeq peptide;Acc:NP_001300979];
  ENSP ID: ENSP00000485302
MPVCPGDSHRPPKALPHLVCGRRGRQVRSDRDKFVIFLDVKHFSPEDLTVKVQDDFVEIHGKHNERQDDHGYISREFHRRYRLPSNVDQSALSCSLSADGMLTFCGPKIQTGLDATHAERAIPVSREEKPTSAPSS

SEQ ID NO: 4308 - protein, 127 aa, Homo sapiens
  Payload ID: 960;
  Gene Symbol:;
  Gene Name: alpha-crystallin A chain [Source:RefSeq peptide;Acc:NP_001300979];
  ENSP ID: ENSP00000485653
MDAPPPHPTTGLLSEPRVRSDRDKFVIFLDVKHFSPEDLTVKVQDDFVEIHGKHNERQDDHGYISREFHRRYRLPSNVDQSALSCSLSADGMLTFCGPKIQTGLDATHAERAIPVSREEKPTSAPSS

SEQ ID NO: 4309 - protein, 622 aa, Homo sapiens
  Payload ID: 961;
  Gene Symbol: AFP;
  Gene Name: alpha-fetoprt;
  ENSP ID: ENSP00000226359
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGKRRQNESFIRCELFSLILTDLTLFVN

SEQ ID NO: 4310 - protein, 609 aa, Homo sapiens
  Payload ID: 961;
  Gene Symbol: AFP;
  Gene Name: alpha-fetoprt;
  Uniprot ID:  P02771;
  ENSP ID: ENSP00000379138
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 4311 - protein, 1244 aa, Homo sapiens
  Payload ID: 962;
  Gene Symbol: ALPK1;
  Gene Name: alpha-kinase 1;
  Uniprot ID:  Q96QP1;
  ENSP ID: ENSP00000177648
MNNQKVVAVLLQECKQVLDQLLLEAPDVSEEDKSEDQRCRALLPSELRTLIQEAKEMKWPFVPEKWQYKQAVGPEDKTNLKDVIGAGLQQLLASLRASILARDCAAAAAIVFLVDRFLYGLDVSGKLLQVAKGLHKLQPATPIAPQVVIRQARISVNSGKLLKAEYILSSLISNNGATGTWLYRNESDKVLVQSVCIQIRGQILQKLGMWYEAAELIWASIVGYLALPQPDKKGLSTSLGILADIFVSMSKNDYEKFKNNPQINLSLLKEFDHHLLSAAEACKLAAAFSAYTPLFVLTAVNIRGTCLLSYSSSNDCPPELKNLHLCEAKEAFEIGLLTKRDDEPVTGKQELHSFVKAAFGLTTVHRRLHGETGTVHAASQLCKEAMGKLYNFSTSSRSQDREALSQEVMSVIAQVKEHLQVQSFSNVDDRSYVPESFECRLDKLILHGQGDFQKILDTYSQHHTSVCEVFESDCGNNKNEQKDAKTGVCITALKTEIKNIDTVSTTQEKPHCQRDTGISSSLMGKNVQRELRRGGRRNWTHSDAFRVSLDQDVETETEPSDYSNGEGAVFNKSLSGSQTSSAWSNLSGFSSSASWEEVNYHVDDRSARKEPGKEHLVDTQCSTALSEELENDREGRAMHSLHSQLHDLSLQEPNNDNLEPSQNQPQQQMPLTPFSPHNTPGIFLAPGAGLLEGAPEGIQEVRNMGPRNTSAHSRPSYRSASWSSDSGRPKNMGTHPSVQKEEAFEIIVEFPETNCDVKDRQGKEQGEEISERGAGPTFKASPSWVDPEGETAESTEDAPLDFHRVLHNSLGNISMLPCSSFTPNWPVQNPDSRKSGGPVAEQGIDPDASTVDEEGQLLDSMDVPCTNGHGSHRLCILRQPPGQRAETPNSSVSGNILFPVLSEDCTTTEEGNQPGNMLNCSQNSSSSSVWWLKSPAFSSGSSEGDSPWSYLNSSGSSWVSLPGKMRKEILEARTLQPDDFEKLLAGVRHDWLFQRLENTGVFKPSQLHRAHSALLLKYSKKSELWTAQETIVYLGDYLTVKKKGRQRNAFWVHHLHQEEILGRYVGKDYKEQKGLWHHFTDVERQMTAQHYVTEFNKRLYEQNIPTQIFYIPSTILLILEDKTIKGCISVEPYILGEFVKLSNNTKVVKTEYKATEYGLAYGHFSYEFSNHRDVVVDLQGWVTGNGKGLIYLTDPQIHSVDQKVFTTNFGKRGIFYFFNNQHVECNEICHRLSLTRPSMEKPCT

SEQ ID NO: 4312 - protein, 1244 aa, Homo sapiens; identical to SEQ ID NO: 4311
  Payload ID: 962;
  Gene Symbol: ALPK1;
  Gene Name: alpha-kinase 1;
  Uniprot ID:  Q96QP1;
  ENSP ID: ENSP00000398048

SEQ ID NO: 4313 - protein, 168 aa, Homo sapiens
  Payload ID: 962;
  Gene Symbol: ALPK1;
  Gene Name: alpha-kinase 1;
  ENSP ID: ENSP00000423978
MNNQKVVAVLLQECKQVLDQLLLEAPDVSEEDKSEDQRCRALLPSELRTLIQEAKEMKWPFVPEKWQYKQAVGPEDKTNLKDVIGAGLQQLLASLRASILARDCAAAAAIVFLVDRFLYGLDVSGKLLQVAKGLHKLQPATPIAPQVVIRQARISVNSDTVQLPTLPT

SEQ ID NO: 4314 - protein, 133 aa, Homo sapiens
  Payload ID: 962;
  Gene Symbol: ALPK1;
  Gene Name: alpha-kinase 1;
  ENSP ID: ENSP00000424492
MNNQKVVAVLLQECKQVLDQLLLEAPDVSEEDKSEDQRCRGVPEGLHPRSGLCGCGGYCVLGGPVPVWARRLWKTSAGRQRSPQVAASHANCPAGGYSPSPNLRELRKTFKSRVYSEQSNKQQWSNGYLAVQK

SEQ ID NO: 4315 - protein, 109 aa, Homo sapiens
  Payload ID: 962;
  Gene Symbol: ALPK1;
  Gene Name: alpha-kinase 1;
  ENSP ID: ENSP00000425273
MNNQKVVAVLLQECKQVLDQLLLEAPDVSEEDKSEDQRCRGVPEGLHPRSGLCGCGGYCVLGGPVPVWARRLWKTSAGRQRSPQVAASHANCPAGGYSPSPNLRELRTT

SEQ ID NO: 4316 - protein, 304 aa, Homo sapiens
  Payload ID: 962;
  Gene Symbol: ALPK1;
  Gene Name: alpha-kinase 1;
  ENSP ID: ENSP00000425559
MNNQKVVAVLLQECKQVLDQLLLEAPDVSEEDKSEDQRCRALLPSELRTLIQEAKEMKWPFVPEKWQYKQAVGPEDKTNLKDVIGAGLQQLLASLRASILARDCAAAAAIVFLVDRFLYGLDVSGKLLQVAKGLHKLQPATPIAPQVVIRQARISVNSGKLLKAEYILSSLISNNGATGTWLYRNESDKVLVQSVCIQIRGQILQKLGMWYEAAELIWASIVGYLALPQPDKKGLSTSLGILADIFVSMSKNDYEKFKNNPQINLSLLKEFDHHLLSAAEACKLAAAFSAYTPLFVLTAVVLFC

SEQ ID NO: 4317 - protein, 1166 aa, Homo sapiens
  Payload ID: 962;
  Gene Symbol: ALPK1;
  Gene Name: alpha-kinase 1;
  Uniprot ID:  Q96QP1;
  ENSP ID: ENSP00000426044
MCRKRTRARTSAAEASLRASILARDCAAAAAIVFLVDRFLYGLDVSGKLLQVAKGLHKLQPATPIAPQVVIRQARISVNSGKLLKAEYILSSLISNNGATGTWLYRNESDKVLVQSVCIQIRGQILQKLGMWYEAAELIWASIVGYLALPQPDKKGLSTSLGILADIFVSMSKNDYEKFKNNPQINLSLLKEFDHHLLSAAEACKLAAAFSAYTPLFVLTAVNIRGTCLLSYSSSNDCPPELKNLHLCEAKEAFEIGLLTKRDDEPVTGKQELHSFVKAAFGLTTVHRRLHGETGTVHAASQLCKEAMGKLYNFSTSSRSQDREALSQEVMSVIAQVKEHLQVQSFSNVDDRSYVPESFECRLDKLILHGQGDFQKILDTYSQHHTSVCEVFESDCGNNKNEQKDAKTGVCITALKTEIKNIDTVSTTQEKPHCQRDTGISSSLMGKNVQRELRRGGRRNWTHSDAFRVSLDQDVETETEPSDYSNGEGAVFNKSLSGSQTSSAWSNLSGFSSSASWEEVNYHVDDRSARKEPGKEHLVDTQCSTALSEELENDREGRAMHSLHSQLHDLSLQEPNNDNLEPSQNQPQQQMPLTPFSPHNTPGIFLAPGAGLLEGAPEGIQEVRNMGPRNTSAHSRPSYRSASWSSDSGRPKNMGTHPSVQKEEAFEIIVEFPETNCDVKDRQGKEQGEEISERGAGPTFKASPSWVDPEGETAESTEDAPLDFHRVLHNSLGNISMLPCSSFTPNWPVQNPDSRKSGGPVAEQGIDPDASTVDEEGQLLDSMDVPCTNGHGSHRLCILRQPPGQRAETPNSSVSGNILFPVLSEDCTTTEEGNQPGNMLNCSQNSSSSSVWWLKSPAFSSGSSEGDSPWSYLNSSGSSWVSLPGKMRKEILEARTLQPDDFEKLLAGVRHDWLFQRLENTGVFKPSQLHRAHSALLLKYSKKSELWTAQETIVYLGDYLTVKKKGRQRNAFWVHHLHQEEILGRYVGKDYKEQKGLWHHFTDVERQMTAQHYVTEFNKRLYEQNIPTQIFYIPSTILLILEDKTIKGCISVEPYILGEFVKLSNNTKVVKTEYKATEYGLAYGHFSYEFSNHRDVVVDLQGWVTGNGKGLIYLTDPQIHSVDQKVFTTNFGKRGIFYFFNNQHVECNEICHRLSLTRPSMEKPCT

SEQ ID NO: 4318 - protein, 2170 aa, Homo sapiens
  Payload ID: 963;
  Gene Symbol: ALPK2;
  Gene Name: alpha-kinase 2;
  Uniprot ID:  Q86TB3;
  ENSP ID: ENSP00000354991
MKDSEGPQRPPLCFLSTLLSQKVPEKSDAVLRCIISGQPKPEVTWYKNGQAIDGSGIISNYEFFENQYIHVLHLSCCTKNDAAVYQISAKNSFGMICCSASVEVECSSENPQLSPNLEDDRDRGWKHETGTHEEERANQIDEKEHPYKEEESISPGTPRSADSSPSKSNHSLSLQSLGNLDISVSSSENPLGVKGTRHTGEAYDPSNTEEIANGLLFLNSSHIYEKQDRCCHKTVHSMASKFTDGDLNNDGPHDEGLRSSQQNPKVQKYISFSLPLSEATAHIYPGDSAVANKQPSPQLSSEDSDSDYELCPEITLTYTEEFSDDDLEYLECSDVMTDYSNAVWQRNLLGTEHVFLLESDDEEMEFGEHCLGGCEHFLSGMGCGSRVSGDAGPMVATAGFCGHHSQPQEVGVRSSRVSKHGPSSPQTGMTLILGPHQDGTSSVTEQGRYKLPTAPEAAENDYPGIQGETRDSHQAREEFASDNLLNMDESVRETEMKLLSGESENSGMSQCWETAADKRVGGKDLWSKRGSRKSARVRQPGMKGNPKKPNANLRESTTEGTLHLCSAKESAEPPLTQSDKRETSHTTAAATGRSSHADARECAISTQAEQEAKTLQTSTDSVSKEGNTNCKGEGMQVNTLFETSQVPDWSDPPQVQVQETVRETISCSQMPAFSEPAGEESPFTGTTTISFSNLGGVHKENASLAQHSEVKPCTCGPQHEEKQDRDGNIPDNFREDLKYEQSISEANDETMSPGVFSRHLPKDARADFREPVAVSVASPEPTDTALTLENVCDEPRDREAVCAMECFEAGDQGTCFDTIDSLVGRPVDKYSPQEICSVDTELAEGQNKVSDLCSSNDKTLEVFFQTQVSETSVSTCKSSKDGNSVMSPLFTSTFTLNISHTASEGATGENLAKVENSTYPLASTVHAGQEQPSPSNSGGLDETQLLSSENNPLVQFKEGGDKSPSPSAADTTATPASYSSIVSFPWEKPTTLTANNECFQATRETEDTSTVTIATEVHPAKYLAVSIPEDKHAGGTEERFPRASHEKVSQFPSQVQLDHILSGATIKSTKELLCRAPSVPGVPHHVLQLPEGEGFCSNSPLQVDNLSGDKSQTVDRADFRSYEENFQERGSETKQGVQQQSLSQQGSLSAPDFQQSLPTTSAAQEERNLVPTAHSPASSREGAGQRSGWGTRVSVVAETAGEEDSQALSNVPSLSDILLEESKEYRPGNWEAGNKLKIITLEASASEIWPPRQLTNSESKASDGGLIIPDKVWAVPDSLKADAVVPELAPSEIAALAHSPEDAESALADSRESHKGEEPTISVHWRSLSSRGFSQPRLLESSVDPVDEKELSVTDSLSAASETGGKENVNNVSQDQEEKQLKMDHTAFFKKFLTCPKILESSVDPIDEISVIEYTRAGKPEPSETTPQGAREGGQSNDGNMGHEAEIQPAILQVPCLQGTILSENRISRSQEGSMKQEAEQIQPEEAKTAIWQVLQPSEGGERIPSGCSIGQIQESSDGSLGEAEQSKKDKAELISPTSPLSSCLPIMTHASLGVDTHNSTGQIHDVPENDIVEPRKRQYVFPVSQKRGTIENERGKPLPSSPDLTRFPCTSSPEGNVTDFLISHKMEEPKIEVLQIGETKPPSSSSSSAKTLAFISGERELEKAPKLLQDPCQKGTLGCAKKSREREKSLEARAGKSPGTLTAVTGSEEVKRKPEAPGSGHLAEGVKKKILSRVAALRLKLEEKENIRKNSAFLKKMPKLETSLSHTEEKQDPKKPSCKREGRAPVLLKKIQAEMFPEHSGNVKLSCQFAEIHEDSTICWTKDSKSIAQVQRSAGDNSTVSFAIVQASPKDQGLYYCCIKNSYGKVTAEFNLTAEVLKQLSSRQDTKGCEEIEFSQLIFKEDFLHDSYFGGRLRGQIATEELHFGEGVHRKAFRSTVMHGLMPVFKPGHACVLKVHNAIAYGTRNNDELIQRNYKLAAQECYVQNTARYYAKIYAAEAQPLEGFGEVPEIIPIFLIHRPENNIPYATVEEELIGEFVKYSIRDGKEINFLRRESEAGQKCCTFQHWVYQKTSGCLLVTDMQGVGMKLTDVGIATLAKGYKGFKGNCSMTFIDQFKALHQCNKYCKMLGLKSLQNNNQKQKQPSIGKSKVQTNSMTIKKAGPETPGEKKT

SEQ ID NO: 4319 - protein, 1907 aa, Homo sapiens
  Payload ID: 964;
  Gene Symbol: ALPK3;
  Gene Name: alpha-kinase 3;
  Uniprot ID:  Q96L96;
  ENSP ID: ENSP00000258888
MEVAWLVYVLGQQPLARQGEGQSRLVPGRGLVLWLPGLPRSSPSWPAVDLAPLAPARPRGPLICHTGHEQAGREPGPGSSTKGPVLHDQDTRCAFLPRPPGPLQTRRYCRHQGRQGSGLGAGPGAGTWAPAPPGVSKPRCPGRARPGEGQQQVTTARPPAINRGARQPRAGAAAAGRGPGAGAWRTGEAAASAGPAVGEGGAMGSRRAPSRGWGAGGRSGAGGDGEDDGPVWIPSPASRSYLLSVRPETSLSSNRLSHPSSGRSTFCSIIAQLTEETQPLFETTLKSRSVSEDSDVRFTCIVTGYPEPEVTWYKDDTELDRYCGLPKYEITHQGNRHTLQLYRCREEDAAIYQASAQNSKGIVSCSGVLEVGTMTEYKIHQRWFAKLKRKAAAKLREIEQSWKHEKAVPGEVDTLRKLSPDRFQRKRRLSGAQAPGPSVPTREPEGGTLAAWQEGETETAQHSGLGLINSFASGEVTTNGEAAPENGEDGEHGLLTYICDAMELGPQRALKEESGAKKKKKDEESKQGLRKPELEKAAQSRRSSENCIPSSDEPDSCGTQGPVGVEQVQTQPRGRAARGPGSSGTDSTRKPASAVGTPDKAQKAPGPGPGQEVYFSLKDMYLENTQAVRPLGEEGPQTLSVRAPGESPKGKAPLRARSEGVPGAPGQPTHSLTPQPTRPFNRKRFAPPKPKGEATTDSKPISSLSQAPECGAQSLGKAPPQASVQVPTPPARRRHGTRDSTLQGQAGHRTPGEVLECQTTTAPTMSASSSSDVASIGVSTSGSQGIIEPMDMETQEDGRTSANQRTGSKKNVQADGKIQVDGRTRGDGTQTAQRTRADRKTQVDAGTQESKRPQSDRSAQKGMMTQGRAETQLETTQAGEKIQEDRKAQADKGTQEDRRMQGEKGMQGEKGTQSEGSAPTAMEGQSEQEVATSLGPPSRTPKLPPTAGPRAPLNIECFVQTPEGSCFPKKPGCLPRSEEAVVTASRNHEQTVLGPLSGNLMLPAQPPHEGSVEQVGGERCRGPQSSGPVEAKQEDSPFQCPKEERPGGVPCMDQGGCPLAGLSQEVPTMPSLPGTGLTASPKAGPCSTPTSQHGSTATFLPSEDQVLMSSAPTLHLGLGTPTQSHPPETMATSSEGACAQVPDVEGRTPGPRSCDPGLIDSLKNYLLLLLKLSSTETSGAGGESQVGAATGGLVPSATLTPTVEVAGLSPRTSRRILERVENNHLVQSAQTLLLSPCTSRRLTGLLDREVQAGRQALAAARGSWGPGPSSLTVPAIVVDEEDPGLASEGASEGEGEVSPEGPGLLGASQESSMAGRLGEAGGQAAPGQGPSAESIAQEPSQEEKFPGEALTGLPAATPEELALGARRKRFLPKVRAAGDGEATTPEERESPTVSPRGPRKSLVPGSPGTPGRERRSPTQGRKASMLEVPRAEEELAAGDLGPSPKAGGLDTEVALDEGKQETLAKPRKAKDLLKAPQVIRKIRVEQFPDASGSLKLWCQFFNILSDSVLTWAKDQRPVGEVGRSAGDEGPAALAIVQASPVDCGVYRCTIHNEHGSASTDFCLSPEVLSGFISREEGEVGEEIEMTPMVFAKGLADSGCWGDKLFGRLVSEELRGGGYGCGLRKASQAKVIYGLEPIFESGRTCIIKVSSLLVFGPSSETSLVGRNYDVTIQGCKIQNMSREYCKIFAAEARAAPGFGEVPEIIPLYLIYRPANNIPYATLEEDLGKPLESYCSREWGCAEAPTASGSSEAMQKCQTFQHWLYQWTNGSFLVTDLAGVDWKMTDVQIATKLRGYQGLKESCFPALLDRFASSHQCNAYCELLGLTPLKGPEAAHPQAKAKGSKSPSAGRKGSQLSPQPQKKGLPSPQGTRKSAPSSKATPQASEPVTTQLLGQPPTQEEGSKAQGMR

SEQ ID NO: 4320 - protein, 382 aa, Homo sapiens
  Payload ID: 965;
  Gene Symbol: AMACR;
  Gene Name: alpha-methylacyl-CoA racemase;
  Uniprot ID:  Q9UHK6;
  ENSP ID: ENSP00000334424
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGVLSKIGRSGENPYAPLNLLADFAGGGLMCALGIIMALFDRTRTGKGQVIDANMVEGTAYLSSFLWKTQKLSLWEAPRGQNMLDGGAPFYTTYRTADGEFMAVGAIEPQFYELLIKGLGLKSDELPNQMSMDDWPEMKKKFADVFAEKTKAEWCQIFDGTDACVTPVLTFEEVVHHDHNKERGSFITSEEQDVSPRPAPLLLNTPAIPSFKRDPFIGEHTEEILEEFGFSREEIYQLNSDKIIESNKVKASL

SEQ ID NO: 4321 - protein, 198 aa, Homo sapiens
  Payload ID: 965;
  Gene Symbol: AMACR;
  Gene Name: alpha-methylacyl-CoA racemase;
  Uniprot ID:  Q9UHK6;
  ENSP ID: ENSP00000371504
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGGRNSIFKFFSVENSEIESVGSTSRTEHVGWWSTFLYDLQDSRWGIHGCWSNRTPVLRAADQRTWTKV

SEQ ID NO: 4322 - protein, 394 aa, Homo sapiens
  Payload ID: 965;
  Gene Symbol: AMACR;
  Gene Name: alpha-methylacyl-CoA racemase;
  Uniprot ID:  Q9UHK6;
  ENSP ID: ENSP00000371517
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGVLSKIGRSGENPYAPLNLLADFAGGGLMCALGIIMALFDRTRTGKGQVIDANMVEGTAYLSSFLWKTQKLSLWEAPRGQNMLDGGAPFYTTYRTADGEFMAVGAIEPQFYELLIKGLGLKSDELPNQMSMDDWPEMKKKFADVFAEKTKAEWCQIFDGTDACVTPVLTFEEVVHHDHNKERGSFITSEEQDVSPRPAPLLLNTPAIPSFKRDPFIGEHTEEILEEFGFSREEIYQLNSDKIIESNKAGSKFWILYPTHSNIQK

SEQ ID NO: 4323 - protein, 367 aa, Homo sapiens
  Payload ID: 965;
  Gene Symbol: AMACR;
  Gene Name: alpha-methylacyl-CoA racemase;
  ENSP ID: ENSP00000424351
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGVLSKIGRSGENPYAPLNLLADFAGGGLMCALGIIMALFDRTRTGKGQVIDANMKLSLWEAPRGQNMLDGGAPFYTTYRTADGEFMAVGAIEPQFYELLIKGLGLKSDELPNQMSMDDWPEMKKKFADVFAEKTKAEWCQIFDGTDACVTPVLTFEEVVHHDHNKERGSFITSEEQDVSPRPAPLLLNTPAIPSFKRDPFIGEHTEEILEEFGFSREEIYQLNSDKIIESNKVKASL

SEQ ID NO: 4324 - protein, 229 aa, Homo sapiens
  Payload ID: 965;
  Gene Symbol: AMACR;
  Gene Name: alpha-methylacyl-CoA racemase;
  Uniprot ID:  Q9UHK6;
  ENSP ID: ENSP00000427227
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGGRNSIFKFFSVENSEIESVGSTSRTEHVGWWSTFLYDLQDSRWGIHGCWSNRTPVLRAADQRSLIPYFNLYLQFLNISMQNLFKVHTLLRPCYFLGQK

SEQ ID NO: 4325 - protein, 288 aa, Homo sapiens
  Payload ID: 965;
  Gene Symbol: AMACR;
  Gene Name: alpha-methylacyl-CoA racemase;
  ENSP ID: ENSP00000476965
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGVLSKIGRSGENPYAPLNLLADFAGGGLMCALGIIMALFDRTRTGKGQVIDANMVEGTAYLSSFLWKTQKLSLWEAPRGQNMLDGGAPFYTTYRTADGEFMAVGAIEPQFYELLIKGLGELILLKIQQEAVSCQARQTLVSVKQWPSLQPKSWGFVWQ

SEQ ID NO: 4326 - protein, 281 aa, Homo sapiens
  Payload ID: 965;
  Gene Symbol: AMACR;
  Gene Name: alpha-methylacyl-CoA racemase;
  ENSP ID: ENSP00000477108
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGGRNSIFKFFSVENSEIESVGSTSRTEHVGWWSTFLYDLQDSRWGIHGCWSNRTPVLRAADQRSGRTDLAENTTGSSIVPGKANPRQCEAMAIVAAQVMGFCVAVTVGGGNGHFELDVFKPMMIKNLCYTQAAGGCFSFLHRKLNSGNPDQ

SEQ ID NO: 4327 - protein, 260 aa, Homo sapiens
  Payload ID: 965;
  Gene Symbol: AMACR;
  Gene Name: alpha-methylacyl-CoA racemase;
  ENSP ID: ENSP00000477411
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGVLSKIGRSGENPYAPLNLLADFAGGGLMCALGIIMALFDRTRTGKGQVIDANMVEGTAYLSSFLWKTQKLSLWEAPRGQNMLDGGAPFYTTYRTADGEFMAVGAIEPQFYELLIKGCWGMLQFPSQKTK

SEQ ID NO: 4328 - protein, 333 aa, Homo sapiens
  Payload ID: 966;
  Gene Symbol: AMMECR1;
  Gene Name: Alport syndrome, mental retardation, midface hypoplasia and elliptocytosis chromosomal region gene 1;
  Uniprot ID:  Q9Y4X0;
  ENSP ID: ENSP00000262844
MAAGCCGVKKQKLSSSPPSGSGGGGGASSSSHCSGESQCRAGELGLGGAGTRLNGLGGLTGGGSGSGCTLSPPQGCGGGGGGIALSPPPSCGVGTLLSTPAAATSSSPSSSSAASSSSPGSRKMVVSAEMCCFCFDVLYCHLYGYQQPRTPRFTNEPYPLFVTWKIGRDKRLRGCIGTFSAMNLHSGLREYTLTSALKDSRFPPMTRDELPRLFCSVSLLTNFEDVCDYLDWEVGVHGIRIEFINEKGSKRTATYLPEVAKEQGWDHIQTIDSLLRKGGYKAPITNEFRKTIKLTRYRSEKMTLSYAEYLAHRQHHHFQNGIGHPLPPYNHYS

SEQ ID NO: 4329 - protein, 210 aa, Homo sapiens
  Payload ID: 966;
  Gene Symbol: AMMECR1;
  Gene Name: Alport syndrome, mental retardation, midface hypoplasia and elliptocytosis chromosomal region gene 1;
  Uniprot ID:  Q9Y4X0;
  ENSP ID: ENSP00000361127
MVVSAEMCCFCFDVLYCHLYGYQQPRTPRFTNEPYPLFVTWKIGRDKRLRGCIGTFSAMNLHSGLREYTLTSALKDSRFPPMTRDELPRLFCSVSLLTNFEDVCDYLDWEVGVHGIRIEFINEKGSKRTATYLPEVAKEQGWDHIQTIDSLLRKGGYKAPITNEFRKTIKLTRYRSEKMTLSYAEYLAHRQHHHFQNGIGHPLPPYNHYS

SEQ ID NO: 4330 - protein, 296 aa, Homo sapiens
  Payload ID: 966;
  Gene Symbol: AMMECR1;
  Gene Name: Alport syndrome, mental retardation, midface hypoplasia and elliptocytosis chromosomal region gene 1;
  Uniprot ID:  Q9Y4X0;
  ENSP ID: ENSP00000361129
MAAGCCGVKKQKLSSSPPSGSGGGGGASSSSHCSGESQCRAGELGLGGAGTRLNGLGGLTGGGSGSGCTLSPPQGCGGGGGGIALSPPPSCGVGTLLSTPAAATSSSPSSSSAASSSSPGSRKMVVSAEMCCFCFDVLYCHLYGYQQPRTPRFTNEPYALKDSRFPPMTRDELPRLFCSVSLLTNFEDVCDYLDWEVGVHGIRIEFINEKGSKRTATYLPEVAKEQGWDHIQTIDSLLRKGGYKAPITNEFRKTIKLTRYRSEKMTLSYAEYLAHRQHHHFQNGIGHPLPPYNHYS

SEQ ID NO: 4331 - protein, 953 aa, Homo sapiens
  Payload ID: 967;
  Gene Symbol: ALS2CL;
  Gene Name: ALS2 C-terminal like;
  Uniprot ID:  Q60I27;
  ENSP ID: ENSP00000313670
MCNPEEAALLRLEEVFSATLAHVNSLVLQPLLPAAPDPSDPWGRECLRLLQQLHKSSQQLWEVTEESLHSLQERLRYPDSTGLESLLLLRGADRVLQAHIEYIESYTSCMVVQAFQKAAKRRSEYWRGQRKALRQLLSGVSSEGSVGASLGQALHQPLAHHVQQYVLLLLSLGDTIGEHHPTRELVVNAVTLFGNLQSFMKQELDQAVATQALWHTLRGRLRDVLCTPAHRLLQDSQDVPVTVAPLRAERVLLFDDALVLLQGHNVHTFDLKLVWVDPGQDGCTFHLLTPEEEFSFCAKDSQGQAVWQWKVTWAVHQALHGKKDFPVLGAGLEPSQPPDCRCAEYTFQAEGRLCQATYEGEWCRGRPHGKGTLKWPDGRNHVGNFCQGLEHGFGIRLLPQASEDKFDCYKCHWREGSMCGYGICEYSTDEVYKGYFQEGLRHGFGVLESGPQAPQPFRYTGHWERGQRSGYGIEEDGDRGERYIGMWQAGQRHGPGVMVTQAGVCYQGTFQADKTVGPGILLSEDDSLYEGTFTRDLTLMGKGKVTFPNGFTLEGSFGSGAGRGLHTQGVLDTAALPPDPSSTCKRQLGVGAFPVESRWQGVYSPFRDFVCAGCPRDLQEALLGFDVQSSRELRRSQDYLSCERTHPEDSVGSMEDILEELLQHREPKALQLYLRKALSNSLHPLGKLLRTLMLTFQATYAGVGANKHLQELAQEEVKQHAQELWAAYRGLLRVALERKGQALEEDEDTETRDLQVHGLVLPLMLPSFYSELFTLYLLLHEREDSFYSQGIANLSLFPDTQLLEFLDVQKHLWPLKDLTLTSNQRYSLVRDKCFLSATECLQKIMTTVDPREKLEVLERTYGEIEGTVSRVLGREYKLPMDDLLPLLIYVVSRARIQHLGAEIHLIRDMMDPNHTGGLYDFLLTALESCYEHIQKEDMRLHRLPGHWHSRELW

SEQ ID NO: 4332 - protein, 300 aa, Homo sapiens
  Payload ID: 967;
  Gene Symbol: ALS2CL;
  Gene Name: ALS2 C-terminal like;
  Uniprot ID:  Q60I27;
  ENSP ID: ENSP00000373248
MEDILEELLQHREPKALQLYLRKALSNSLHPLGKLLRTLMLTFQATYAGVGANKHLQELAQEEVKQHAQELWAAYRGLLRVALERKGQALEEDEDTETRDLQVHGLVLPLMLPSFYSELFTLYLLLHEREDSFYSQGIANLSLFPDTQLLEFLDVQKHLWPLKDLTLTSNQRYSLVRDKCFLSATECLQKIMTTVDPREKLEVLERTYGEIEGTVSRVLGREYKLPMDDLLPLLIYVVSRARIQHLGAEIHLIRDMMDPNHTGGLYDFLLTALESCYEHIQKEDMRLHRLPGHWHSRELW

SEQ ID NO: 4333 - protein, 302 aa, Homo sapiens
  Payload ID: 967;
  Gene Symbol: ALS2CL;
  Gene Name: ALS2 C-terminal like;
  ENSP ID: ENSP00000395749
  MOD_RES (1)..(1): Any amino acid
XLQERLRYPDSTGLESLLLLRGADRVLQAHIEYIESYTSCMVVQAFQKAAKRRSEYWRGQRKALRQLLSGVSSEGSVGASLGQALHQPLAHHVQQYVLLLLSLGDTIGEHHPTRELVVNAVTLFGNLQSFMKQELDQAVATQALWHTLRGRLRDVLCTPAHRLLQDSQDVPVTVAPLRAERVLLFDDALVLLQGHNVHTFDLKLVWVDPGQDGCTFHLLTPEEEFSFCAKDSQGQAVWQWKVTWAVHQALHGKKDFPVLGAGLEPSQPPDCRCAEYTFQAEGRLCQATYEGEWCRGRPHGEP

SEQ ID NO: 4334 - protein, 535 aa, Homo sapiens
  Payload ID: 967;
  Gene Symbol: ALS2CL;
  Gene Name: ALS2 C-terminal like;
  ENSP ID: ENSP00000405335
MCNPEEAALLRLEEVFSATLAHVNSLVLQPLLPAAPDPSDPWGRECLRLLQQLHKSSQQLWEVTEESLHSLQERLRYPDSTGLESLLLLRGADRVLQAHIEYIESYTSCMVVQAFQKAAKRRSEYWRGQRKALRQLLSGVSSEGSVGASLGQALHQPLAHHVQQYVLLLLSLGDTIGEHHPTRELVVNAVTLFGNLQSFMKQELDQAVATQALWHTLRGRLRDVLCTPAHRLLQDSQDVPVTVAPLRAERVLLFDDALVLLQGHNVHTFDLKLVWVDPGQDGCTFHLLTPEEEFSFCAKDSQGQAVWQWKVTWAVHQALHGKKDFPVLGAGLEPSQPPDCRCAEYTFQAEGRLCQATYEGEWCRGRPHGKGTLKWPDGRNHVGNFCQGLEHGFGIRLLPQASEDKFDCYKCHWREGSMCGYGICTAPTRCTRATSRRACGTDLGSLRVVRRPPSPSGTRATGRGARGAAMALRRMVTEVSATLACGRLVSATAQGSWSPRQVSATRAPSRRTRRWARASSSLKTTPCMRAPSPGT

SEQ ID NO: 4335 - protein, 953 aa, Homo sapiens; identical to SEQ ID NO: 4331
  Payload ID: 967;
  Gene Symbol: ALS2CL;
  Gene Name: ALS2 C-terminal like;
  Uniprot ID:  Q60I27;
  ENSP ID: ENSP00000413223

SEQ ID NO: 4336 - protein, 1023 aa, Homo sapiens
  Payload ID: 968;
  Gene Symbol: ALMS1;
  Gene Name: Alstrom syndrome prt 1;
  ENSP ID: ENSP00000399833
QALPDSELTQEALKVSAVPQPADQKTGLSTVTSSFYSHTEKPNISYQQELPDSHLTEEALKVSNVPGPADQKTGVSTVTSTSYSHREKPIVSYQRELPHFTEAGLKILRVPGPADQKTGINILPSNSYPQREHSVISYEQELPDLTEVTLKAIGVPGPADQKTGIQIASSSSYSNREKASIFHQQELPDVTEEALNVFVVPGQGDRKTEIPTVPLSYYSRREKPSVISQQELPDSHLTEEALKVSPVSIPAEQKTGIPIGLSSSYSHSHKEKLKISTVHIPDDQKTEFPAATLSSYSQIEKPKISTVIGPNDQKTPSQTAFHSSYSQTVKPNILFQQQLPDRDQSKGILKISAVPELTDVNTGKPVSLSSSYFHREKSNIFSPQELPGSHVTEDVLKVSTIPGPAGQKTVLPTALPSSFSHREKPDIFYQKDLPDRHLTEDALKISSALGQADQITGLQTVPSGTYSHGENHKLVSEHVQRLIDNLNSSDSSVSSNNVLLNSQADDRVVINKPESAGFRDVGSEEIQDAENSAKTLKEIRTLLMEAENMALKRCNFPAPLARFRDISDISFIQSKKVVCFKEPSSTGVSNGDLLHRQPFTEESPSSRCIQKDIGTQTNLKCRRGIENWEFISSTTVRSPLQEAESKVSMALEETLRQYQAAKSVMRSEPEGCSGTIGNKIIIPMMTVIKSDSSSDASDGNGSCSWDSNLPESLESVSDVLLNFFPYVSPKTSITDSREEEGVSESEDGGGSSVDSLAAHVKNLLQCESSLNHAKEILRNAEEEESRVRAHAWNMKFNLAHDCGYSISELNEDDRRKVEEIKAELFGHGRTTDLSKGLQSPRGMGCKPEAVCSHIIIESHEKGCFRTLTSEHPQLDRHPCAFRSAGPSEMTRGRQNPSSCRAKHVNLSASLDQNNSHFKVWNSLQLKSHSPFQNFIPDEFKISKGLRMPFDEKMDPWLSELVEPAFVPPKEVDFHSSSQMPSPEPMKKFTTSITFSSHRHSKCISNSSVVKITREDEDPTFCFL

SEQ ID NO: 4337 - protein, 4126 aa, Homo sapiens
  Payload ID: 968;
  Gene Symbol: ALMS1;
  Gene Name: Alstrom syndrome prt 1;
  ENSP ID: ENSP00000478155
MEPEDLPWPGELEEEEEEEEEEEEEEEEAAAAAAANVDDVVVVEEVEEEAGRELDSDSHYGPQHLESIDDEEDEEAKAWLQAHPGRILPPLSPPQHRYSEGERTSLEKKTESWHCLPQEMDSSQTLDTSQTRFNVRTEDTEVTDFPSLEEGILTQSENQVKEPNRDLFCSPLLVIQDSFASPDLPLLTCLTQDQEFAPDSLFHQSELSFAPLRGIPDKSEDTEWSSRPSEVSEALFQATAEVASDLASSRFSVSQHPLIGSTAVGSQCPFLPSEQGNNEETISSVDELKIPKDCDRYDDLCSYMSWKTRKDTQWPENNLADKDQVSVATSFDITDENIATKRSDHFDAARSYGQYWTQEDSSKQAETYLTKGLQGKVESDVITLDGLNENAVVCSERVAELQRKPTRESEYHSSDLRMLRMSPDTVPKAPKHLKAGDTSKGGIAKVTQSNLKSGITTTPVDSDIGSHLSLSLEDLSQLAVSSPLETTTGQHTDTLNQKTLADTHLTEETLKVTAIPEPADQKTATPTVLSSSHSHRGKPSIFYQQGLPDSHLTEEALKVSAAPGLADQTTGMSTLTSTSYSHREKPGTFYQQELPESNLTEEPLEVSAAPGPVEQKTGIPTVSSTSHSHVEDLLFFYRQTLPDGHLTDQALKVSAVSGPADQKTGTATVLSTPHSHREKPGIFYQQEFADSHQTEETLTKVSATPGPADQKTEIPAVQSSSYSQREKPSILYPQDLADSHLPEEGLKVSAVAGPADQKTGLPTVPSSAYSHREKLLVFYQQALLDSHLPEEALKVSAVSGPADGKTGTPAVTSTSSASSSLGEKPSAFYQQTLPNSHLTEEALKVSIVPGPGDQKTGIPSAPSSFYSHREKPIIFSQQTLPDFLFPEEALKVSAVSVLAAQKTGTPTVSSNSHSHSEKSSVFYQQELPDSDLPRESLKMSAIPGLTDQKTVPTPTVPSGSFSHREKPSIFYQQEWPDSYATEKALKVSTGPGPADQKTEIPAVQSSSYPQREKPSVLYPQVLSDSHLPEESLKVSAFPGPADQMTDTPAVPSTFYSQREKPGIFYQQTLPESHLPKEALKISVAPGLADQKTGTPTVTSTSYSQHREKPSIFHQQALPGTHIPEEAQKVSAVTGPGNQKTWIPRVLSTFYSQREKPGIFYQQTLPGSHIPEEAQKVSPVLGPADQKTGTPTPTSASYSHTEKPGIFYQQVLPDNHPTEEALKISVASEPVDQTTGTPAVTSTSYSQYREKPSIFYQQSLPSSHLTEEAKNVSAVPGPADQKTVIPILPSTFYSHTEKPGVFYQQVLPHSHPTEEALKISVASEPVDQTTGTPTVTSTSYSQHTEKPSIFYQQSLPGSHLTEEAKNVSAVPGPGDRKTGIPTLPSTFYSHTEKPGSFYQQVLPHSHLPEEALEVSVAPGPVDQTIGTPTVTSPSSSFGEKPIVIYKQAFPEGHLPEESLKVSVAPGPVGQTTGAPTITSPSYSQHRAKSGSFYQLALLGSQIPEEALRVSSAPGPADQTTGIPTITSTSYSFGEKPIVNYKQAFPDGHLPEEALKVSIVSGPTEKKTDIPAGPLGSSALGEKPITFYRQALLDSPLNKEVVKVSAAPGPADQKTETLPVHSTSYSNRGKPVIFYQQTLSDSHLPEEALKVPPVPGPDAQKTETPSVSSSLYSYREKPIVFYQQALPDSELTQEALKVSAVPQPADQKTGLSTVTSSFYSHTEKPNISYQQELPDSHLTEEALKVSNVPGPADQKTGVSTVTSTSYSHREKPIVSYQRELPHFTEAGLKILRVPGPADQKTGINILPSNSYPQREHSVISYEQELPDLTEVTLKAIGVPGPADQKTGIQIASSSSYSNREKASIFHQQELPDVTEEALNVFVVPGQGDRKTEIPTVPLSYYSRREKPSVISQQELPDSHLTEEALKVSPVSIPAEQKTGIPIGLSSSYSHSHKEKLKISTVHIPDDQKTEFPAATLSSYSQIEKPKISTVIGPNDQKTPSQTAFHSSYSQTVKPNILFQQQLPDRDQSKGILKISAVPELTDVNTGKPVSLSSSYFHREKSNIFSPQELPGSHVTEDVLKVSTIPGPAGQKTVLPTALPSSFSHREKPDIFYQKDLPDRHLTEDALKISSALGQADQITGLQTVPSGTYSHGENHKLVSEHVQRLIDNLNSSDSSVSSNNVLLNSQADDRVVINKPESAGFRDVGSEEIQDAENSAKTLKEIRTLLMEAENMALKRCNFPAPLARFRDISDISFIQSKKVVCFKEPSSTGVSNGDLLHRQPFTEESPSSRCIQKDIGTQTNLKCRRGIENWEFISSTTVRSPLQEAESKVSMALEETLRQYQAAKSVMRSEPEGCSGTIGNKIIIPMMTVIKSDSSSDASDGNGSCSWDSNLPESLESVSDVLLNFFPYVSPKTSITDSREEEGVSESEDGGGSSVDSLAAHVKNLLQCESSLNHAKEILRNAEEEESRVRAHAWNMKFNLAHDCGYSISELNEDDRRKVEEIKAELFGHGRTTDLSKGLQSPRGMGCKPEAVCSHIIIESHEKGCFRTLTSEHPQLDRHPCAFRSAGPSEMTRGRQNPSSCRAKHVNLSASLDQNNSHFKVWNSLQLKSHSPFQNFIPDEFKISKGLRMPFDEKMDPWLSELVEPAFVPPKEVDFHSSSQMPSPEPMKKFTTSITFSSHRHSKCISNSSVVKVGVTEGSQCTGASVGVFNSHFTEEQNPPRDLKQKTSSPSSFKMHSNSQDKEVTILAEGRRQSQKLPVDFERSFQEEKPLERSDFTGSHSEPSTRANCSNFKEIQISDNHTLISMGRPSSTLGVNRSSSRLGVKEKNVTITPDLPSCIFLEQRELFEQSKAPRADDHVRKHHSPSPQHQDYVAPDLPSCIFLEQRELFEQCKAPYVDHQMRENHSPLPQGQDSIASDLPSPISLEQCQSKAPGVDDQMNKHHFPLPQGQDCVVEKNNQHKPKSHISNINVEAKFNTVVSQSAPNHCTLAASASTPPSNRKALSCVHITLCPKTSSKLDSGTLDERFHSLDAASKARMNSEFNFDLHTVSSRSLEPTSKLLTSKPVAQDQESLGFLGPKSSLDFQVVQPSLPDSNTITQDLKTIPSQNSQIVTSRQIQVNISDFEGHSNPEGTPVFADRLPEKMKTPLSAFSEKLSSDAVTQITTESPEKTLFSSEIFINAEDRGHEIIEPGNQKLRKAPVKFASSSSVQQVTFSRGTDGQPLLLPYKPSGSTKMYYVPQLRQIPPSPDSKSDTTVESSHSGSNDAIAPDFPAQVLGTRDDDLSATVNIKHKEGIYSKRVVTKASLPVGEKPLQNENADASVQVLITGDENLSDKKQQEIHSTRAVTEAAQAKEKESLQKDTADSSAAAAAEHSAQVGDPEMKNLPDTKAITQKEEIHRKKTVPEEAWPNNKESLQINIEESECHSEFENTTRSVFRSAKFYIHHPVHLPSDQDICHESLGKSVFMRHSWKDFFQHHPDKHREHMCLPLPYQNMDKTKTDYTRIKSLSINVNLGNKEVMDTTKSQVRDYPKHNGQISDPQRDQKVTPEQTTQHTVSLNELWNKYRERQRQQRQPELGDRKELSLVDRLDRLAKILQNPITHSLQVSESTHDDSRGERSVKEWSGRQQQRNKLQKKKRFKSLEKSHKNTGELKKSKVLSHHRAGRSNQIKIEQIKFDKYILSKQPGFNYISNTSSDCRPSEESELLTDTTTNILSGTTSTVESDILTQTDREVALHERSSSVSTIDTARLIQAFGHERVCLSPRRIKLYSSITNQQRRYLEKRSKHSKKVLNTGHPLVTSEHTRRRHIQVANHVISSDSISSSASSFLSSNSTFCNKQNVHMLNKGIQAGNLEIVNGAKKHTRDVGITFPTPSSSEAKLEENSDVTSWSEEKREEKMLFTGYPEDRKLKKNKKNSHEGVSWFVPVENVESRSKKENVPNTCGPGISWFEPITKTRPWREPLREQNCQGQHLDGRGYLAGPGREAGRDLLRPFVRATLQESLQFHRPDFISRSGERIKRLKLIVQERKLQSMLQTERDALFNIDRERQGHQNRMCPLPKRVFLAIQKNKPISKKEMIQRSKRIYEQLPEVQKKREEEKRKSEYKSYRLRAQLYKKRVTNQLLGRKVPWD

SEQ ID NO: 4338 - protein, 3859 aa, Homo sapiens
  Payload ID: 968;
  Gene Symbol: ALMS1;
  Gene Name: Alstrom syndrome prt 1;
  ENSP ID: ENSP00000479094
MEPEDLPWPGELEEEEEEEEEEEEEEEEAAAAAAANVDDVVVVEEVEEEAGRELDSDSHYGPQHLESIDDEEDEEAKAWLQAHPGRILPPLSPPQHRYSEGERTSLEKIVPLTCHVWQQIVYQGNSRTQISDTNVVCLETTAQRGSGDDQKTESWHCLPQEMDSSQTLDTSQTRFNVRTEDTEVTDFPSLEEGILTQSENQVKEPNRDLFCSPLLVIQDSFASPDLPLLTCLTQDQEFAPDSLFHQSELSFAPLRGIPDKSEDTEWSSRPSEVSEALFQATAEVASDLASSRFSVSQHPLIGSTAVGSQCPFLPSEQGNNEETISSVDELKIPKDCDRYDDLCSYMSWKTRKDTQWPENNLADKDQVSVATSFDITDENIATKRSDHFDAARSYGQYWTQEDSSKQAETYLTKGLQGKVESDVITLDGLNENAVVCSERVAELQRKPTRESEYHSSDLRMLRMSPDTVPKAPKHLKAGDTSKGGIAKVTQSNLKSGITTTPVDSDIGSHLSLSLEDLSQLAVSSPLETTTGQHTDTLNQKTLADTHLTEETLKVTAIPEPADQKTATPTVLSSSHSHRGKPSIFYQQGLPDSHLTEEALKVSAAPGLADQTTGMSTLTSTSYSHREKPGTFYQQELPESNLTEEPLEVSAAPGPVEQKTGIPTVSSTSHSHVEDLLFFYRQTLPDGHLTDQALKVSAVSGPADQKTGTATVLSTPHSHREKPGIFYQQEFADSHQTEETLTKVSATPGPADQKTEIPAVQSSSYSQREKPSILYPQDLADSHLPEEGLKVSAVAGPADQKTGLPTVPSSAYSHREKLLVFYQQALLDSHLPEEALKVSAVSGPADGKTGTPAVTSTSSASSSLGEKPSAFYQQTLPNSHLTEEALKVSIVPGPGDQKTGIPSAPSSFYSHREKPIIFSQQTLPDFLFPEEALKVSAVSVLAAQKTGTPTVSSNSHSHSEKSSVFYQQELPDSDLPRESLKMSAIPGLTDQKTVPTPTVPSGSFSHREKPSIFYQQEWPDSYATEKALKVSTGPGPADQKTEIPAVQSSSYPQREKPSVLYPQVLSDSHLPEESLKVSAFPGPADQMTDTPAVPSTFYSQREKPGIFYQQTLPESHLPKEALKISVAPGLADQKTGTPTVTSTSYSQHREKPSIFHQQALPGTHIPEEAQKVSAVTGPGNQKTWIPRVLSTFYSQREKPGIFYQQTLPGSHIPEEAQKVSPVLGPADQKTGTPTPTSASYSHTEKPGIFYQQVLPDNHPTEEALKISVASEPVDQTTGTPAVTSTSYSQYREKPSIFYQQSLPSSHLTEEAKNVSAVPGPADQKTVIPILPSTFYSHTEKPGVFYQQVLPHSHPTEEALKISVASEPVDQTTGTPTVTSTSYSQHTEKPSIFYQQSLPGSHLTEEAKNVSAVPGPGDRKTGIPTLPSTFYSHTEKPGSFYQQVLPHSHLPEEALEVSVAPGPVDQTIGTPTVTSPSSSFGEKPIVIYKQAFPEGHLPEESLKVSVAPGPVGQTTGAPTITSPSYSQHRAKSGSFYQLALLGSQIPEEALRVSSAPGPADQTTGIPTITSTSYSFGEKPIVNYKQAFPDGHLPEEALKVSIVSGPTEKKTDIPAGPLGSSALGEKPITFYRQALLDSPLNKEVVKVSAAPGPADQKTETLPVHSTSYSNRGKPVIFYQQTLSDSHLPEEALKVPPVPGPDAQKTETPSVSSSLYSYREKPIVFYQQALPDSELTQEALKVSAVPQPADQKTGLSTVTSSFYSHTEKPNISYQQELPDSHLTEEALKVSNVPGPADQKTGVSTVTSTSYSHREKPIVSYQRELPHFTEAGLKILRVPGPADQKTGINILPSNSYPQREHSVISYEQELPDLTEVTLKAIGVPGPADQKTGIQIASSSSYSNREKASIFHQQELPDVTEEALNVFVVPGQGDRKTEIPTVPLSYYSRREKPSVISQQELPDSHLTEEALKVSPVSIPAEQKTGIPIGLSSSYSHSHKEKLKISTVHIPDDQKTEFPAATLSSYSQIEKPKISTVIGPNDQKTPSQTAFHSSYSQTVKPNILFQQQLPDRDQSKGILKISAVPELTDVNTGKPVSLSSSYFHREKSNIFSPQELPGSHVTEDVLKVSTIPGPAGQKTVLPTALPSSFSHREKPDIFYQKDLPDRHLTEDALKISSALGQADQITGLQTVPSGTYSHGENHKLVSEHVQRLIDNLNSSDSSVSSNNVLLNSQADDRVVINKPESAGFRDVGSEEIQDAENSAKTLKEIRTLLMEAENMALKRCNFPAPLARFRDISDISFIQSKKVVCFKEPSSTGVSNGDLLHRQPFTEESPSSRCIQKDIGTQTNLKCRRGIENWEFISSTTVRSPLQEAESKVSMALEETLRQYQAAKSVMRSEPEGCSGTIGNKIIIPMMTVIKSDSSSDASDGNGSCSWDSNLPESLESVSDVLLNFFPYVSPKTSITDSREEEGVSESEDGGGSSVDSLAAHVKNLLQCESSLNHAKEILRNAEEEESRVRAHAWNMKFNLAHDCGYSISELNEDDRRKVEEIKAELFGHGRTTDLSKGLQSPRGMGCKPEAVCSHIIIESHEKGCFRTLTSEHPQLDRHPCAFRSAGPSEMTRGRQNPSSCRAKHVNLSASLDQNNSHFKVWNSLQLKSHSPFQNFIPDEFKISKGLRMPFDEKMDPWLSELVEPAFVPPKEVDFHSSSQMPSPEPMKKFTTSITFSSHRHSKCISNSSVVKVGVTEGSQCTGASVGVFNSHFTEEQNPPRDLKQKTSSPSSFKMHSNSQDKEVTILAEGRRQSQKLPVDFERSFQEEKPLERSDFTGSHSEPSTRANCSNFKEIQISDNHTLISMGRPSSTLGVNRSSSRLGVKEKNVTITPDLPSCIFLEQRELFEQSKAPRADDHVRKHHSPSPQHQDYVAPDLPSCIFLEQRELFEQCKAPYVDHQMRENHSPLPQGQDSIASDLPSPISLEQCQSKAPGVDDQMNKHHFPLPQGQDCVVEKNNQHKPKSHISNINVEAKFNTVVSQSAPNHCTLAASASTPPSNRKALSCVHITLCPKTSSKLDSGTLDERFHSLDAASKARMNSEFNFDLHTVSSRSLEPTSKLLTSKPVAQDQESLGFLGPKSSLDFQVVQPSLPDSNTITQDLKTIPSQNSQIVTSRQIQVNISDFEGHSNPEGTPVFADRLPEKMKTPLSAFSEKLSSDAVTQITTESPEKTLFSSEIFINAEDRGHEIIEPGNQKLRKAPVKFASSSSVQQVTFSRGTDGQPLLLPYKPSGSTKMYYVPQLRQIPPSPDSKSDTTVESSHSGSNDAIAPDFPAQVLGTRDDDLSATVNIKHKEGIYSKRVVTKASLPVGEKPLQNENADASVQVLITGDENLSDKKQQEIHSTRAVTEAAQAKEKESLQKDTADSSAAAAAEHSAQVGDPEMKNLPDTKAITQKEEIHRKKTVPEEAWPNNKESLQINIEESECHSEFENTTRSVFRSAKFYIHHPVHLPSDQDICHESLGKSVFMRHSWKDFFQHHPDKHREHMCLPLPYQNMDKTKTDYTRIKSLSINVNLGNKEVMDTTKSQVRDYPKHNGQISDPQRDQKVTPEQTTQHTVSLNELWNKYRERQRQQRQPELGDRKELSLVDRLDRLAKILQNPITHSLQVSESTHDDSRGERSVKEWSGRQQQRNKLQKKKRFKSLEKSHKNTGELKKSKVLSHHRAGRSNQIKIEQIKFDKYILSKQPGFNYISNTSSDCRPSEESELLTDTTTNILSGTTSTVESDILTQTDREVALHERSSSVSTIDTARLIQAFGHERVCLSPRRIKLYSSITNQQRRYLEKRSKHSKKVLNTGHPLVTSEHTRRRHIQVHGYRFHLAM

SEQ ID NO: 4339 - protein, 4168 aa, Homo sapiens
  Payload ID: 968;
  Gene Symbol: ALMS1;
  Gene Name: Alstrom syndrome prt 1;
  ENSP ID: ENSP00000482968
MEPEDLPWPGELEEEEEEEEEEEEEEEEAAAAAAANVDDVVVVEEVEEEAGRELDSDSHYGPQHLESIDDEEDEEAKAWLQAHPGRILPPLSPPQHRYSEGERTSLEKIVPLTCHVWQQIVYQGNSRTQISDTNVVCLETTAQRGSGDDQKTESWHCLPQEMDSSQTLDTSQTRFNVRTEDTEVTDFPSLEEGILTQSENQVKEPNRDLFCSPLLVIQDSFASPDLPLLTCLTQDQEFAPDSLFHQSELSFAPLRGIPDKSEDTEWSSRPSEVSEALFQATAEVASDLASSRFSVSQHPLIGSTAVGSQCPFLPSEQGNNEETISSVDELKIPKDCDRYDDLCSYMSWKTRKDTQWPENNLADKDQVSVATSFDITDENIATKRSDHFDAARSYGQYWTQEDSSKQAETYLTKGLQGKVESDVITLDGLNENAVVCSERVAELQRKPTRESEYHSSDLRMLRMSPDTVPKAPKHLKAGDTSKGGIAKVTQSNLKSGITTTPVDSDIGSHLSLSLEDLSQLAVSSPLETTTGQHTDTLNQKTLADTHLTEETLKVTAIPEPADQKTATPTVLSSSHSHRGKPSIFYQQGLPDSHLTEEALKVSAAPGLADQTTGMSTLTSTSYSHREKPGTFYQQELPESNLTEEPLEVSAAPGPVEQKTGIPTVSSTSHSHVEDLLFFYRQTLPDGHLTDQALKVSAVSGPADQKTGTATVLSTPHSHREKPGIFYQQEFADSHQTEETLTKVSATPGPADQKTEIPAVQSSSYSQREKPSILYPQDLADSHLPEEGLKVSAVAGPADQKTGLPTVPSSAYSHREKLLVFYQQALLDSHLPEEALKVSAVSGPADGKTGTPAVTSTSSASSSLGEKPSAFYQQTLPNSHLTEEALKVSIVPGPGDQKTGIPSAPSSFYSHREKPIIFSQQTLPDFLFPEEALKVSAVSVLAAQKTGTPTVSSNSHSHSEKSSVFYQQELPDSDLPRESLKMSAIPGLTDQKTVPTPTVPSGSFSHREKPSIFYQQEWPDSYATEKALKVSTGPGPADQKTEIPAVQSSSYPQREKPSVLYPQVLSDSHLPEESLKVSAFPGPADQMTDTPAVPSTFYSQREKPGIFYQQTLPESHLPKEALKISVAPGLADQKTGTPTVTSTSYSQHREKPSIFHQQALPGTHIPEEAQKVSAVTGPGNQKTWIPRVLSTFYSQREKPGIFYQQTLPGSHIPEEAQKVSPVLGPADQKTGTPTPTSASYSHTEKPGIFYQQVLPDNHPTEEALKISVASEPVDQTTGTPAVTSTSYSQYREKPSIFYQQSLPSSHLTEEAKNVSAVPGPADQKTVIPILPSTFYSHTEKPGVFYQQVLPHSHPTEEALKISVASEPVDQTTGTPTVTSTSYSQHTEKPSIFYQQSLPGSHLTEEAKNVSAVPGPGDRKTGIPTLPSTFYSHTEKPGSFYQQVLPHSHLPEEALEVSVAPGPVDQTIGTPTVTSPSSSFGEKPIVIYKQAFPEGHLPEESLKVSVAPGPVGQTTGAPTITSPSYSQHRAKSGSFYQLALLGSQIPEEALRVSSAPGPADQTTGIPTITSTSYSFGEKPIVNYKQAFPDGHLPEEALKVSIVSGPTEKKTDIPAGPLGSSALGEKPITFYRQALLDSPLNKEVVKVSAAPGPADQKTETLPVHSTSYSNRGKPVIFYQQTLSDSHLPEEALKVPPVPGPDAQKTETPSVSSSLYSYREKPIVFYQQALPDSELTQEALKVSAVPQPADQKTGLSTVTSSFYSHTEKPNISYQQELPDSHLTEEALKVSNVPGPADQKTGVSTVTSTSYSHREKPIVSYQRELPHFTEAGLKILRVPGPADQKTGINILPSNSYPQREHSVISYEQELPDLTEVTLKAIGVPGPADQKTGIQIASSSSYSNREKASIFHQQELPDVTEEALNVFVVPGQGDRKTEIPTVPLSYYSRREKPSVISQQELPDSHLTEEALKVSPVSIPAEQKTGIPIGLSSSYSHSHKEKLKISTVHIPDDQKTEFPAATLSSYSQIEKPKISTVIGPNDQKTPSQTAFHSSYSQTVKPNILFQQQLPDRDQSKGILKISAVPELTDVNTGKPVSLSSSYFHREKSNIFSPQELPGSHVTEDVLKVSTIPGPAGQKTVLPTALPSSFSHREKPDIFYQKDLPDRHLTEDALKISSALGQADQITGLQTVPSGTYSHGENHKLVSEHVQRLIDNLNSSDSSVSSNNVLLNSQADDRVVINKPESAGFRDVGSEEIQDAENSAKTLKEIRTLLMEAENMALKRCNFPAPLARFRDISDISFIQSKKVVCFKEPSSTGVSNGDLLHRQPFTEESPSSRCIQKDIGTQTNLKCRRGIENWEFISSTTVRSPLQEAESKVSMALEETLRQYQAAKSVMRSEPEGCSGTIGNKIIIPMMTVIKSDSSSDASDGNGSCSWDSNLPESLESVSDVLLNFFPYVSPKTSITDSREEEGVSESEDGGGSSVDSLAAHVKNLLQCESSLNHAKEILRNAEEEESRVRAHAWNMKFNLAHDCGYSISELNEDDRRKVEEIKAELFGHGRTTDLSKGLQSPRGMGCKPEAVCSHIIIESHEKGCFRTLTSEHPQLDRHPCAFRSAGPSEMTRGRQNPSSCRAKHVNLSASLDQNNSHFKVWNSLQLKSHSPFQNFIPDEFKISKGLRMPFDEKMDPWLSELVEPAFVPPKEVDFHSSSQMPSPEPMKKFTTSITFSSHRHSKCISNSSVVKVGVTEGSQCTGASVGVFNSHFTEEQNPPRDLKQKTSSPSSFKMHSNSQDKEVTILAEGRRQSQKLPVDFERSFQEEKPLERSDFTGSHSEPSTRANCSNFKEIQISDNHTLISMGRPSSTLGVNRSSSRLGVKEKNVTITPDLPSCIFLEQRELFEQSKAPRADDHVRKHHSPSPQHQDYVAPDLPSCIFLEQRELFEQCKAPYVDHQMRENHSPLPQGQDSIASDLPSPISLEQCQSKAPGVDDQMNKHHFPLPQGQDCVVEKNNQHKPKSHISNINVEAKFNTVVSQSAPNHCTLAASASTPPSNRKALSCVHITLCPKTSSKLDSGTLDERFHSLDAASKARMNSEFNFDLHTVSSRSLEPTSKLLTSKPVAQDQESLGFLGPKSSLDFQVVQPSLPDSNTITQDLKTIPSQNSQIVTSRQIQVNISDFEGHSNPEGTPVFADRLPEKMKTPLSAFSEKLSSDAVTQITTESPEKTLFSSEIFINAEDRGHEIIEPGNQKLRKAPVKFASSSSVQQVTFSRGTDGQPLLLPYKPSGSTKMYYVPQLRQIPPSPDSKSDTTVESSHSGSNDAIAPDFPAQVLGTRDDDLSATVNIKHKEGIYSKRVVTKASLPVGEKPLQNENADASVQVLITGDENLSDKKQQEIHSTRAVTEAAQAKEKESLQKDTADSSAAAAAEHSAQVGDPEMKNLPDTKAITQKEEIHRKKTVPEEAWPNNKESLQINIEESECHSEFENTTRSVFRSAKFYIHHPVHLPSDQDICHESLGKSVFMRHSWKDFFQHHPDKHREHMCLPLPYQNMDKTKTDYTRIKSLSINVNLGNKEVMDTTKSQVRDYPKHNGQISDPQRDQKVTPEQTTQHTVSLNELWNKYRERQRQQRQPELGDRKELSLVDRLDRLAKILQNPITHSLQVSESTHDDSRGERSVKEWSGRQQQRNKLQKKKRFKSLEKSHKNTGELKKSKVLSHHRAGRSNQIKIEQIKFDKYILSKQPGFNYISNTSSDCRPSEESELLTDTTTNILSGTTSTVESDILTQTDREVALHERSSSVSTIDTARLIQAFGHERVCLSPRRIKLYSSITNQQRRYLEKRSKHSKKVLNTGHPLVTSEHTRRRHIQVANHVISSDSISSSASSFLSSNSTFCNKQNVHMLNKGIQAGNLEIVNGAKKHTRDVGITFPTPSSSEAKLEENSDVTSWSEEKREEKMLFTGYPEDRKLKKNKKNSHEGVSWFVPVENVESRSKKENVPNTCGPGISWFEPITKTRPWREPLREQNCQGQHLDGRGYLAGPGREAGRDLLRPFVRATLQESLQFHRPDFISRSGERIKRLKLIVQERKLQSMLQTERDALFNIDRERQGHQNRMCPLPKRVFLAIQKNKPISKKEMIQRSKRIYEQLPEVQKKREEEKRKSEYKSYRLRAQLYKKRVTNQLLGRKVPWD

SEQ ID NO: 4340 - protein, 553 aa, Homo sapiens
  Payload ID: 969;
  Gene Symbol: ASPSCR1;
  Gene Name: alveolar soft part sarcoma chromosome region, candidate 1;
  Uniprot ID:  Q9BZE9;
  ENSP ID: ENSP00000302176
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 4341 - protein, 647 aa, Homo sapiens
  Payload ID: 969;
  Gene Symbol: ASPSCR1;
  Gene Name: alveolar soft part sarcoma chromosome region, candidate 1;
  Uniprot ID:  Q9BZE9;
  ENSP ID: ENSP00000306625
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQPQLGDRVAPFTLGPSLKRCLGPEQRTRLPVVGDGGDVDSGRLLFWGPSRGRASPSTGQPPCHPVCRPSSPPSPRPSSGDPSRVKAGHKHVGTGRANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 4342 - protein, 58 aa, Homo sapiens
  Payload ID: 969;
  Gene Symbol: ASPSCR1;
  Gene Name: alveolar soft part sarcoma chromosome region, candidate 1;
  ENSP ID: ENSP00000344020
MAAPAGGGGSAVSVLAPNGRRHTVKVTPSTVLLQVLEDTCRRQDFNPCEYDLKCPWAV

SEQ ID NO: 4343 - protein, 179 aa, Homo sapiens
  Payload ID: 969;
  Gene Symbol: ASPSCR1;
  Gene Name: alveolar soft part sarcoma chromosome region, candidate 1;
  ENSP ID: ENSP00000461980
RVLFPDRYVLQGFFRPSETVGDLRDFVRSHLGNPELSFYLFITPPKTVLDDHTQTLFQANLFPAALVHLGAEEPAGVYLEPGLLEHAISPSAADVLVARYMSRAAGSPSPLPAPDPAPKSEPAAEEGALVPPEPIPGTAQPVKRSLGKPARGESCQPEVPTPPATGPPPLPAGIKTCAS

SEQ ID NO: 4344 - protein, 188 aa, Homo sapiens
  Payload ID: 969;
  Gene Symbol: ASPSCR1;
  Gene Name: alveolar soft part sarcoma chromosome region, candidate 1;
  ENSP ID: ENSP00000461984
  MOD_RES (1)..(1): Any amino acid
XRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEPSPGQWRETRALESTTCFMEKEGVAGPRSPGCPETSLGALFVFSASLKAQESQKWFHLINICF

SEQ ID NO: 4345 - protein, 353 aa, Homo sapiens
  Payload ID: 969;
  Gene Symbol: ASPSCR1;
  Gene Name: alveolar soft part sarcoma chromosome region, candidate 1;
  ENSP ID: ENSP00000462218
MKCYDPVGKTPGSLGSSASAGQAAASAPLPLESGELSRGDLSRPEDADTSGPCCEHTQEKQSTRAPAAAPFVPFSGGGQRLGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQANLFPAALVHLGAEEPAGVYLEPGLLEHAISPSAADVLVARYMSRAAGSPSPLPAPDPAPKSEPAAEEGALVP

SEQ ID NO: 4346 - protein, 501 aa, Homo sapiens
  Payload ID: 969;
  Gene Symbol: ASPSCR1;
  Gene Name: alveolar soft part sarcoma chromosome region, candidate 1;
  Uniprot ID:  Q9BZE9;
  ENSP ID: ENSP00000462329
MVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLCLSSFGRMDGRGPRCFLTRRCLLSSVITPPKTVLDDHTQTLFQANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 4347 - protein, 307 aa, Homo sapiens
  Payload ID: 969;
  Gene Symbol: ASPSCR1;
  Gene Name: alveolar soft part sarcoma chromosome region, candidate 1;
  ENSP ID: ENSP00000463316
MGVFPEAATKPLLSMGWCGKSLSACGSAGAPVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPTRPLTSSSAKLPKSLSSPGGPSKPKKSKSGQDPQQEQEQERERDPQQEQERE

SEQ ID NO: 4348 - protein, 4 aa, Homo sapiens
  Payload ID: 969;
  Gene Symbol: ASPSCR1;
  Gene Name: alveolar soft part sarcoma chromosome region, candidate 1;
  ENSP ID: ENSP00000463708
MPSW

SEQ ID NO: 4349 - protein, 470 aa, Homo sapiens
  Payload ID: 969;
  Gene Symbol: ASPSCR1;
  Gene Name: alveolar soft part sarcoma chromosome region, candidate 1;
  ENSP ID: ENSP00000463992
MVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKTESLSVAQAGVSGAISAHCKLRLPGSSGSPASASQVAGISGGSEGPVPRPLRPTGLLPPQRDSGGLARLREEPPGEPRAVILPVHHPSKNSPGRPHADPLSGEPLPGRSGALGSRGAGRCLPGAWPAGACHLPICGRCAGGQVHVQGRRVPFPIASP

SEQ ID NO: 4350 - protein, 160 aa, Homo sapiens
  Payload ID: 969;
  Gene Symbol: ASPSCR1;
  Gene Name: alveolar soft part sarcoma chromosome region, candidate 1;
  ENSP ID: ENSP00000464044
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQISPWTGSPWTGSRWCATPTWRSGCRPGQRSCLMSSLS

SEQ ID NO: 4351 - protein, 182 aa, Homo sapiens
  Payload ID: 969;
  Gene Symbol: ASPSCR1;
  Gene Name: alveolar soft part sarcoma chromosome region, candidate 1;
  ENSP ID: ENSP00000464408
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVGGLLLLTQSPLTFSPLSNWKICCPAAVSRAVAGDSGS

SEQ ID NO: 4352 - protein, 326 aa, Homo sapiens
  Payload ID: 970;
  Gene Symbol: ALX1;
  Gene Name: ALX homeobox 1;
  Uniprot ID:  Q15699;
  ENSP ID: ENSP00000315417
MEFLSEKFALKSPPSKNSDFYMGAGGPLEHVMETLDNESFYSKASAGKCVQAFGPLPRAEHHVRLERTSPCQDSSVNYGITKVEGQPLHTELNRAMDNCNSLRMSPVKGMQEKGELDELGDKCDSNVSSSKKRRHRTTFTSLQLEELEKVFQKTHYPDVYVREQLALRTELTEARVQVWFQNRRAKWRKRERYGQIQQAKSHFAATYDISVLPRTDSYPQIQNNLWAGNASGGSVVTSCMLPRDTSSCMTPYSHSPRTDSSYTGFSNHQNQFSHVPLNNFFTDSLLTGATNGHAFETKPEFERRSSSIAVLRMKAKEHTANISWAM

SEQ ID NO: 4353 - protein, 343 aa, Homo sapiens
  Payload ID: 971;
  Gene Symbol: ALX3;
  Gene Name: ALX homeobox 3;
  Uniprot ID:  O95076;
  ENSP ID: ENSP00000358807
MDPEHCAPFRVGPAPGPYVASGDEPPGPQGTPAAAPHLHPAPPRGPRLTRFPACGPLEPYLPEPAKPPAKYLQDLGPGPALNGGHFYEGPAEAEEKTSKAASFPQLPLDCRGGPRDGPSNLQGSPGPCLASLHLPLSPGLPDSMELAKNKSKKRRNRTTFSTFQLEELEKVFQKTHYPDVYAREQLALRTDLTEARVQVWFQNRRAKWRKRERYGKIQEGRNPFTAAYDISVLPRTDSHPQLQNSLWASPGSGSPGGPCLVSPEGIPSPCMSPYSHPHGSVAGFMGVPAPSAAHPGIYSIHGFPPTLGGHSFEPSSDGDYKSPSLVSLRVKPKEPPGLLNWTT

SEQ ID NO: 4354 - protein, 411 aa, Homo sapiens
  Payload ID: 972;
  Gene Symbol: ALX4;
  Gene Name: ALX homeobox 4;
  Uniprot ID:  Q9H161;
  ENSP ID: ENSP00000332744
MNAETCVSYCESPAAAMDAYYSPVSQSREGSSPFRAFPGGDKFGTTFLSAAAKAQGFGDAKSRARYGAGQQDLATPLESGAGARGSFNKFQPQPSTPQPQPPPQPQPQQQQPQPQPPAQPHLYLQRGACKTPPDGSLKLQEGSSGHSAALQVPCYAKESSLGEPELPPDSDTVGMDSSYLSVKEAGVKGPQDRASSDLPSPLEKADSESNKGKKRRNRTTFTSYQLEELEKVFQKTHYPDVYAREQLAMRTDLTEARVQVWFQNRRAKWRKRERFGQMQQVRTHFSTAYELPLLTRAENYAQIQNPSWLGNNGAASPVPACVVPCDPVPACMSPHAHPPGSGASSVTDFLSVSGAGSHVGQTHMGSLFGAASLSPGLNGYELNGEPDRKTSSIAALRMKAKEHSAAISWAT

SEQ ID NO: 4355 - protein, 264 aa, Homo sapiens
  Payload ID: 973;
  Gene Symbol: ALYREF;
  Gene Name: Aly/REF export factor;
  ENSP ID: ENSP00000421592
MPDSAPAMADKMDMSLDDIIKLNRSQRGGRGGGRGRGRAGSQGGRGGGAQAAARVNRGGGPIRNRPAIARGAAGGGGRNRPAPYSRPKQLPDKWQHDLFDSGFGGGAGVETGGKLLVSNLDFGVSDADIQELFAEFGTLKKAAVHYDRSGRSLGTADVHFERKADALKAMKQYNGVPLDGRPMNIQLVTSQIDAQRRPAQSVNRGGMTRNRGAGGFGGGGGTRRGTRGGARGRGRGAGRNSKQQLSAEELDAQLDAYNARMDTS

SEQ ID NO: 4356 - protein, 447 aa, Homo sapiens
  Payload ID: 974;
  Gene Symbol: AMBN;
  Gene Name: ameloblastin (enamel matrix prt);
  Uniprot ID:  Q9NP70;
  ENSP ID: ENSP00000313809
MSASKIPLFKMKDLILILCLLEMSFAVPFFPQQSGTPGMASLSLETMRQLGSLQRLNTLSQYSRYGFGKSFNSLWMHGLLPPHSSLPWMRPREHETQQYEYSLPVHPPPLPSQPSLKPQQPGLKPFLQSAAATTNQATALKEALQPPIHLGHLPLQEGELPLVQQQVAPSDKPPKPELPGVDFADPQGPSLPGMDFPDPQGPSLPGLDFADPQGSTIFQIARLISHGPMPQNKQSPLYPGMLYVPFGANQLNAPARLGIMSSEEVAGGREDPMAYGAMFPGFGGMRPGFEGMPHNPAMGGDFTLEFDSPVAATKGPENEEGGAQGSPMPEANPDNLENPAFLTELEPAPHAGLLALPKDDIPGLPRSPSGKMKGLPSVTPAAADPLMTPELADVYRTYDADMTTSVDFQEEATMDTTMAPNSLQTSMPGNKAQEPEMMHDAWHFQEP

SEQ ID NO: 4357 - protein, 432 aa, Homo sapiens
  Payload ID: 974;
  Gene Symbol: AMBN;
  Gene Name: ameloblastin (enamel matrix prt);
  Uniprot ID:  Q9NP70;
  ENSP ID: ENSP00000391234
MSASKIPLFKMKDLILILCLLEMSFAVPFFPQQSGTPGMASLSLETMRQLGSLQRLNTLSQYSRYGFGKSFNSLWMHGLLPPHSSLPWMRPREHETQQPSLKPQQPGLKPFLQSAAATTNQATALKEALQPPIHLGHLPLQEGELPLVQQQVAPSDKPPKPELPGVDFADPQGPSLPGMDFPDPQGPSLPGLDFADPQGSTIFQIARLISHGPMPQNKQSPLYPGMLYVPFGANQLNAPARLGIMSSEEVAGGREDPMAYGAMFPGFGGMRPGFEGMPHNPAMGGDFTLEFDSPVAATKGPENEEGGAQGSPMPEANPDNLENPAFLTELEPAPHAGLLALPKDDIPGLPRSPSGKMKGLPSVTPAAADPLMTPELADVYRTYDADMTTSVDFQEEATMDTTMAPNSLQTSMPGNKAQEPEMMHDAWHFQEP

SEQ ID NO: 4358 - protein, 446 aa, Homo sapiens [sequence omitted]

SEQ ID NO: 4359 - protein, 175 aa, Homo sapiens
  Payload ID: 975;
  Gene Symbol: AMELX;
  Gene Name: amelogenin, X-linked;
  Uniprot ID:  Q99217;
  ENSP ID: ENSP00000335312
MGTWILFACLLGAAFAMPVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 4360 - protein, 205 aa, Homo sapiens
  Payload ID: 975;
  Gene Symbol: AMELX;
  Gene Name: amelogenin, X-linked;
  Uniprot ID:  Q99217;
  ENSP ID: ENSP00000370088
MGTWILFACLLGAAFAMPLPPHPGHPGYINFSYENSHSQAINVDRTALVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 4361 - protein, 191 aa, Homo sapiens
  Payload ID: 975;
  Gene Symbol: AMELX;
  Gene Name: amelogenin, X-linked;
  Uniprot ID:  Q99217;
  ENSP ID: ENSP00000370090
MGTWILFACLLGAAFAMPLPPHPGHPGYINFSYEVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 4362 - protein, 192 aa, Homo sapiens
  Payload ID: 976;
  Gene Symbol: AMELY;
  Gene Name: amelogenin, Y-linked;
  Uniprot ID:  Q99218;
  ENSP ID: ENSP00000215479
MGTWILFACLVGAAFAMPLPPHPGHPGYINFSYEVLTPLKWYQSMIRPPYSSYGYEPMGGWLHHQIIPVVSQQHPLTHTLQSHHHIPVVPAQQPRVRQQALMPVPGQQSMTPTQHHQPNLPLPAQQPFQPQPVQPQPHQPMQPQPPVQPMQPLLPQPPLPPMFPLRPLPPILPDLHLEAWPATDKTKQEEVD

SEQ ID NO: 4363 - protein, 206 aa, Homo sapiens
  Payload ID: 976;
  Gene Symbol: AMELY;
  Gene Name: amelogenin, Y-linked;
  Uniprot ID:  Q99218;
  ENSP ID: ENSP00000372505
MGTWILFACLVGAAFAMPLPPHPGHPGYINFSYENSHSQAINVDRIALVLTPLKWYQSMIRPPYSSYGYEPMGGWLHHQIIPVVSQQHPLTHTLQSHHHIPVVPAQQPRVRQQALMPVPGQQSMTPTQHHQPNLPLPAQQPFQPQPVQPQPHQPMQPQPPVQPMQPLLPQPPLPPMFPLRPLPPILPDLHLEAWPATDKTKQEEVD

SEQ ID NO: 4364 - protein, 209 aa, Homo sapiens
  Payload ID: 977;
  Gene Symbol: AMTN;
  Gene Name: amelotin;
  Uniprot ID:  Q6UX39;
  ENSP ID: ENSP00000341013
MRSTILLFCLLGSTRSLPQLKPALGLPPTKLAPDQGTLPNQQQSNQVFPSLSLIPLTQMLTLGPDLHLLNPAAGMTPGTQTHPLTLGGLNVQQQLHPHVLPIFVTQLGAQGTILSSEELPQIFTSLIIHSLFPGGILPTSQAGANPDVQDGSLPAGGAGVNPATQGTPAGRLPTPSGTDDDFAVTTPAGIQRSTHAIEEATTESANGIQ

SEQ ID NO: 4365 - protein, 208 aa, Homo sapiens
  Payload ID: 977;
  Gene Symbol: AMTN;
  Gene Name: amelotin;
  Uniprot ID:  Q6UX39;
  ENSP ID: ENSP00000422452
MRSTILLFCLLGSTRSLPLKPALGLPPTKLAPDQGTLPNQQQSNQVFPSLSLIPLTQMLTLGPDLHLLNPAAGMTPGTQTHPLTLGGLNVQQQLHPHVLPIFVTQLGAQGTILSSEELPQIFTSLIIHSLFPGGILPTSQAGANPDVQDGSLPAGGAGVNPATQGTPAGRLPTPSGTDDDFAVTTPAGIQRSTHAIEEATTESANGIQ

SEQ ID NO: 4366 - protein, 426 aa, Homo sapiens
  Payload ID: 978;
  Gene Symbol: AMDHD1;
  Gene Name: amidohydrolase domain containing 1;
  Uniprot ID:  Q96NU7;
  ENSP ID: ENSP00000266736
MASGHSLLLENAQQVVLVCARGERFLARDALRSLAVLEGASLVVGKDGFIKAIGPADVIQRQFSGETFEEIIDCSGKCILPGLVDAHTHPVWAGERVHEFAMKLAGATYMEIHQAGGGIHFTVERTRQATEEELFRSLQQRLQCMMRAGTTLVECKSGYGLDLETELKMLRVIERARRELDIGISATYCGAHSVPKGKTATEAADDIINNHLPKLKELGRNGEIHVDNIDVFCEKGVFDLDSTRRILQRGKDIGLQINFHGDELHPMKAAELGAELGAQAISHLEEVSDEGIVAMATARCSAILLPTTAYMLRLKQPRARKMLDEGVIVALGSDFNPNAYCFSMPMVMHLACVNMRMSMPEALAAATINAAYALGKSHTHGSLEVGKQGDLIIINSSRWEHLIYQFGGHHELIEYVIAKGKLIYKT

SEQ ID NO: 4367 - protein, 111 aa, Homo sapiens
  Payload ID: 978;
  Gene Symbol: AMDHD1;
  Gene Name: amidohydrolase domain containing 1;
  ENSP ID: ENSP00000448632
  MOD_RES (1)..(1): Any amino acid
XLVVGKDGFIKAIGPADVIQRQFSGETFEEIIDCSGKCILPVGRSHLHGNSPGRRRDPLYRGAHAPSHRGGAVPLLAATAPVHDEGWHHAGGVQEWIWPRPGDRAQDAARD

SEQ ID NO: 4368 - protein, 6 aa, Homo sapiens
  Payload ID: 978;
  Gene Symbol: AMDHD1;
  Gene Name: amidohydrolase domain containing 1;
  ENSP ID: ENSP00000448918
MKLAGA

SEQ ID NO: 4369 - protein, 409 aa, Homo sapiens
  Payload ID: 979;
  Gene Symbol: AMDHD2;
  Gene Name: amidohydrolase domain containing 2;
  Uniprot ID:  Q9Y303;
  ENSP ID: ENSP00000293971
MRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGTKTLSGSIAPMDVCVRHFLQATGCSMESALEAASLHPAQLLGLEKSKGTLDFGADADFVVLDDSLHVQATYISGELVWQADAARQ

SEQ ID NO: 4370 - protein, 439 aa, Homo sapiens
  Payload ID: 979;
  Gene Symbol: AMDHD2;
  Gene Name: amidohydrolase domain containing 2;
  Uniprot ID:  Q9Y303;
  ENSP ID: ENSP00000307481
MRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGERPDPLGPRSQPACQVAHDPPRACPLCSQGTKTLSGSIAPMDVCVRHFLQATGCSMESALEAASLHPAQLLGLEKSKGTLDFGADADFVVLDDSLHVQATYISGELVWQADAARQ

SEQ ID NO: 4371 - protein, 594 aa, Homo sapiens
  Payload ID: 979;
  Gene Symbol: AMDHD2;
  Gene Name: amidohydrolase domain containing 2;
  Uniprot ID:  Q9Y303;
  ENSP ID: ENSP00000391596
MRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGERPDPLGPRSQPACQVAHDPPRACPLCSQGTKTLSGSIAPMDVCVRHFLQATGCSMESALEAASLHPAQLLGLEKSKGTLDFGADADFVVLDDSLHVQATYISGPVLAGCGDPAWCWRAVWEAPVCPAHPISVILPSSVSPWPWHTPMWQTRAVRLPEQLRGGWASGALLALRTATVGSDVRDWCSPTSGVIVLTFSPFEFWGGWLPSPLLTGAVLGTGGTRLALPLFSSLCCKAQLRKCLQVQRDRMVWAPPVGREQPGKNHLPGQGLA

SEQ ID NO: 4372 - protein, 155 aa, Homo sapiens
  Payload ID: 979;
  Gene Symbol: AMDHD2;
  Gene Name: amidohydrolase domain containing 2;
  ENSP ID: ENSP00000456656
MRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKIPVKSGGPHGAGVLGLHLEGPFISREKRGAHPEAH

SEQ ID NO: 4373 - protein, 300 aa, Homo sapiens
  Payload ID: 979;
  Gene Symbol: AMDHD2;
  Gene Name: amidohydrolase domain containing 2;
  ENSP ID: ENSP00000456898
MRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGCSMESALEAASLHPAQLLGLEKSKGTLDFGADADFVVLDDSLHVQAT

SEQ ID NO: 4374 - protein, 165 aa, Homo sapiens
  Payload ID: 979;
  Gene Symbol: AMDHD2;
  Gene Name: amidohydrolase domain containing 2;
  ENSP ID: ENSP00000457021
MRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKGCTWRAPSSAGRSGARTPRPTSAPSRPMPSRTCWPPTGPWTMSAS

SEQ ID NO: 4375 - protein, 269 aa, Homo sapiens
  Payload ID: 979;
  Gene Symbol: AMDHD2;
  Gene Name: amidohydrolase domain containing 2;
  ENSP ID: ENSP00000457136
MLPFHHRDPGIVGLLTSDRLPAGRCIFYGMIADGTHTNPAALRIAHRAHPQGLVLVTDAIPALGLGNGRHTLGQQEVEVDGLTAYVAGERPDPLGPRSQPACQVAHDPPRACPLCSQGTKTLSGSIAPMDVCVRHFLQATGCSMESALEAASLHPAQLLGLEKSKGTLDFGADADFVVLDDSLHVQATYISGPVLAGCGDPAWCWRAVWEAPVCPAHPISVILPSSVSPWPWHTPMWQTRAVRLPEQLRGGWASGALLALRTATVGSDV

SEQ ID NO: 4376 - protein, 296 aa, Homo sapiens
  Payload ID: 979;
  Gene Symbol: AMDHD2;
  Gene Name: amidohydrolase domain containing 2;
  ENSP ID: ENSP00000457398
MRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGERPDPLGPRSQPACQVAHDPPRACPLCSQGTKTLSGSIAPMDV

SEQ ID NO: 4377 - protein, 751 aa, Homo sapiens
  Payload ID: 980;
  Gene Symbol: AOC1;
  Gene Name: amine oxidase, copper containing 1;
  Uniprot ID:  P19801;
  ENSP ID: ENSP00000354193
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRTYRLQIHSMADQVLPPGWQEEQAITWARYPLAVTKYRESELCSSSIYHQNDPWHPPVVFEQFLHNNENIENEDLVAWVTVGFLHIPHSEDIPNTATPGNSVGFLLRPFNFFPEDPSLASRDTVIVWPRDNGPNYVQRWIPEDRDCSMPPPFSYNGTYRPV

SEQ ID NO: 4378 - protein, 770 aa, Homo sapiens
  Payload ID: 980;
  Gene Symbol: AOC1;
  Gene Name: amine oxidase, copper containing 1;
  Uniprot ID:  P19801;
  ENSP ID: ENSP00000411613
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRTYRLQIHSMADQVLPPGWQEEQAITWARTEGGQPRALSQAASPVPGRYPLAVTKYRESELCSSSIYHQNDPWHPPVVFEQFLHNNENIENEDLVAWVTVGFLHIPHSEDIPNTATPGNSVGFLLRPFNFFPEDPSLASRDTVIVWPRDNGPNYVQRWIPEDRDCSMPPPFSYNGTYRPV

SEQ ID NO: 4379 - protein, 337 aa, Homo sapiens
  Payload ID: 980;
  Gene Symbol: AOC1;
  Gene Name: amine oxidase, copper containing 1;
  ENSP ID: ENSP00000417392
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVL

SEQ ID NO: 4380 - protein, 751 aa, Homo sapiens; identical to SEQ ID NO: 4377
  Payload ID: 980;
  Gene Symbol: AOC1;
  Gene Name: amine oxidase, copper containing 1;
  Uniprot ID:  P19801;
  ENSP ID: ENSP00000418328

SEQ ID NO: 4381 - protein, 249 aa, Homo sapiens
  Payload ID: 980;
  Gene Symbol: AOC1;
  Gene Name: amine oxidase, copper containing 1;
  ENSP ID: ENSP00000418557
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEEL

SEQ ID NO: 4382 - protein, 751 aa, Homo sapiens; identical to SEQ ID NO: 4377
  Payload ID: 980;
  Gene Symbol: AOC1;
  Gene Name: amine oxidase, copper containing 1;
  Uniprot ID:  P19801;
  ENSP ID: ENSP00000418614

SEQ ID NO: 4383 - protein, 194 aa, Homo sapiens
  Payload ID: 980;
  Gene Symbol: AOC1;
  Gene Name: amine oxidase, copper containing 1;
  ENSP ID: ENSP00000481520
MEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRTYRLQIHSMADQVLPPGWQEEQAITWARYPLAVTKYRESELCSSSIYHQNDPWHPPWSLSSFFTTTRTLKMRTWWPG

SEQ ID NO: 4384 - protein, 710 aa, Homo sapiens
  Payload ID: 980;
  Gene Symbol: AOC1;
  Gene Name: amine oxidase, copper containing 1;
  ENSP ID: ENSP00000481717
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDRCLGARGMTAQRSRPSSPPQAPRGLPQPHPCERPPLGPAPRPSLQAGGQRCALRRLELCLPLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGCARHSPAHPPDWQHTHSLVHYRVDLDVAGTKNSFQTLQMKLENITNPWSPRHRVVQPTLEQTQYSWERQAAFRFKRKLPKYLLFTSPQENPWGHKRTYRLQIHSMADQVLPPGWQEEQAITWARYPLAVTKYRESELCSSSIYHQNDPWHPPVVFEQFLHNNENIENEDLVAWVTVGFLHIPHSEDIPNTATPGNSVGFLLRPFNFFPEDPWHPETL

SEQ ID NO: 4385 - protein, 756 aa, Homo sapiens
  Payload ID: 981;
  Gene Symbol: AOC2;
  Gene Name: amine oxidase, copper containing 2 (retina-specific);
  Uniprot ID:  O75106;
  ENSP ID: ENSP00000253799
MHLKIVLAFLALSLITIFALAYVLLTSPGGSSQPPHCPSVSHRAQPWPHPGQSQLFADLSREELTAVMRFLTQRLGPGLVDAAQAQPSDNCIFSVELQLPPKAAALAHLDRGSPPPAREALAIVLFGGQPQPNVSELVVGPLPHPSYMRDVTVERHGGPLPYHRRPVLRAEFTQMWRHLKEVELPKAPIFLSSTFNYNGSTLAAVHATPRGLRSGDRATWMALYHNISGVGLFLHPVGLELLLDHRALDPAHWTVQQVFYLGHYYADLGQLEREFKSGRLEVVRVPLPPPNGASSLRSRNSPGPLPPLQFSPQGSQYSVQGNLVVSSLWSFTFGHGVFSGLRIFDVRFQGERIAYEVSVQECVSIYGADSPKTMLTRYLDSSFGLGRNSRGLVRGVDCPYQATMVDIHILVGKGAVQLLPGAVCVFEEAQGLPLRRHHNYLQNHFYGGLASSALVVRSVSSVGNYDYIWDFVLYPNGALEGRVHATGYINTAFLKGGEEGLLFGNRVGERVLGTVHTHAFHFKLDLDVAGLKNWVVAEDVVFKPVAAPWNPEHWLQRPQLTRQVLGKEDLTAFSLGSPLPRYLYLASNQTNAWGHQRGYRIQIHSPLGIHIPLESDMERALSWGRYQLVVTQRKEEESQSSSIYHQNDIWTPTVTFADFINNETLLGEDLVAWVTASFLHIPHAEDIPNTVTLGNRVGFLLRPYNFFDEDPSIFSPGSVYFEKGQDAGLCSINPVACLPDLAACVPDLPPFSYHGF

SEQ ID NO: 4386 - protein, 729 aa, Homo sapiens
  Payload ID: 981;
  Gene Symbol: AOC2;
  Gene Name: amine oxidase, copper containing 2 (retina-specific);
  Uniprot ID:  O75106;
  ENSP ID: ENSP00000406134
MHLKIVLAFLALSLITIFALAYVLLTSPGGSSQPPHCPSVSHRAQPWPHPGQSQLFADLSREELTAVMRFLTQRLGPGLVDAAQAQPSDNCIFSVELQLPPKAAALAHLDRGSPPPAREALAIVLFGGQPQPNVSELVVGPLPHPSYMRDVTVERHGGPLPYHRRPVLRAEFTQMWRHLKEVELPKAPIFLSSTFNYNGSTLAAVHATPRGLRSGDRATWMALYHNISGVGLFLHPVGLELLLDHRALDPAHWTVQQVFYLGHYYADLGQLEREFKSGRLEVVRVPLPPPNGASSLRSRNSPGPLPPLQFSPQGSQYSVQGNLVVSSLWSFTFGHGVFSGLRIFDVRFQGERIAYEVSVQECVSIYGADSPKTMLTRYLDSSFGLGRNSRGLVRGVDCPYQATMVDIHILVGKGAVQLLPGAVCVFEEAQGLPLRRHHNYLQNHFYGGLASSALVVRSVSSVGNYDYIWDFVLYPNGALEGRVHATGYINTAFLKGGEEGLLFGNRVGERVLGTVHTHAFHFKLDLDVAGLKNWVVAEDVVFKPVAAPWNPEHWLQRPQLTRQVLGKEDLTAFSLGSPLPRYLYLASNQTNAWGHQRGYQLVVTQRKEEESQSSSIYHQNDIWTPTVTFADFINNETLLGEDLVAWVTASFLHIPHAEDIPNTVTLGNRVGFLLRPYNFFDEDPSIFSPGSVYFEKGQDAGLCSINPVACLPDLAACVPDLPPFSYHGF

SEQ ID NO: 4387 - protein, 763 aa, Homo sapiens
  Payload ID: 982;
  Gene Symbol: AOC3;
  Gene Name: amine oxidase, copper containing 3;
  Uniprot ID:  Q16853;
  ENSP ID: ENSP00000312326
MNQKTILVLLILAVITIFALVCVLLVGRGGDGGEPSQLPHCPSVSPSAQPWTHPGQSQLFADLSREELTAVMRFLTQRLGPGLVDAAQARPSDNCVFSVELQLPPKAAALAHLDRGSPPPAREALAIVFFGRQPQPNVSELVVGPLPHPSYMRDVTVERHGGPLPYHRRPVLFQEYLDIDQMIFNRELPQASGLLHHCCFYKHRGRNLVTMTTAPRGLQSGDRATWFGLYYNISGAGFFLHHVGLELLVNHKALDPARWTIQKVFYQGRYYDSLAQLEAQFEAGLVNVVLIPDNGTGGSWSLKSPVPPGPAPPLQFYPQGPRFSVQGSRVASSLWTFSFGLGAFSGPRIFDVRFQGERLVYEISLQEALAIYGGNSPAAMTTRYVDGGFGMGKYTTPLTRGVDCPYLATYVDWHFLLESQAPKTIRDAFCVFEQNQGLPLRRHHSDLYSHYFGGLAETVLVVRSMSTLLNYDYVWDTVFHPSGAIEIRFYATGYISSAFLFGATGKYGNQVSEHTLGTVHTHSAHFKVDLDVAGLENWVWAEDMVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTVTVGNGVGFFLRPYNFFDEDPSFYSADSIYFRGDQDAGACEVNPLACLPQAAACAPDLPAFSHGGFSHN

SEQ ID NO: 4388 - protein, 144 aa, Homo sapiens
  Payload ID: 982;
  Gene Symbol: AOC3;
  Gene Name: amine oxidase, copper containing 3;
  ENSP ID: ENSP00000464787
  MOD_RES (1)..(1): Any amino acid
XYDYVWDTVFHPSGAIEIRFYATGYISSAFLFGATGKYGNQVSEHTLGTVHTHSAHFKVDLDVAGDPEAAGDGGAGRLPRGKRHPSLPVPGQQPQQQVGSPPGLPHPDAQLCWRAAAPKQLHGERLQLGEVPAGCDPAEGGGAQ

SEQ ID NO: 4389 - protein, 152 aa, Homo sapiens
  Payload ID: 982;
  Gene Symbol: AOC3;
  Gene Name: amine oxidase, copper containing 3;
  ENSP ID: ENSP00000465913
MVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTV

SEQ ID NO: 4390 - protein, 112 aa, Homo sapiens
  Payload ID: 982;
  Gene Symbol: AOC3;
  Gene Name: amine oxidase, copper containing 3;
  ENSP ID: ENSP00000468043
MVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWA

SEQ ID NO: 4391 - protein, 220 aa, Homo sapiens
  Payload ID: 982;
  Gene Symbol: AOC3;
  Gene Name: amine oxidase, copper containing 3;
  Uniprot ID:  Q16853;
  ENSP ID: ENSP00000468632
MVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTVTVGNGVGFFLRPYNFFDEDPSFYSADSIYFRGDQDAGACEVNPLACLPQAAACAPDLPAFSHGGFSHN

SEQ ID NO: 4392 - protein, 220 aa, Homo sapiens; identical to SEQ ID NO: 4391
  Payload ID: 982;
  Gene Symbol: AOC3;
  Gene Name: amine oxidase, copper containing 3;
  Uniprot ID:  Q16853;
  ENSP ID: ENSP00000477686

SEQ ID NO: 4393 - protein, 634 aa, Homo sapiens
  Payload ID: 982;
  Gene Symbol: AOC3;
  Gene Name: amine oxidase, copper containing 3;
  Uniprot ID:  Q16853;
  ENSP ID: ENSP00000484312
MNQKTILVLLILAVITIFALVCVLLVGRGGDGGEPSQLPHCPSVSPSAQPWTHPGQSQLFADLSREELTAVMRFLTQRLGPGLVDAAQARPSDNCVFSVELQLPPKAAALAHLDRGSPPPAREALAIVFFGRQPQPNVSELVVGPLPHPSYMRDVTVERHGGPLPYHRRPVLFQEYLDIDQMIFNRELPQASGLLHHCCFYKHRGRNLVTMTTAPRGLQSGDRATWFGLYYNISGAGFFLHHVGLELLVNHKALDPARWTIQKVFYQGRYYDSLAQLEAQFEAGLVNVVLIPDNGTGGSWSLKSPVPPGPAPPLQFYPQGPRFSVQGSRVASSLWTFSFGLGAFSGPRIFDVRFQGERLVYEISLQEALAIYGGNSPAAMTTRYVDGGFGMGKYTTPLTRGVDCPYLATYVDWHFLLESQAPKTIRDAFCVFEQNQGLPLRRHHSDLYSHYFGGLAETVLVVRSMSTLLNYDYVWDTVFHPSGAIEIRFYATGYISSAFLFGATGKYGNQVSEHTLGTVHTHSAHFKVDLDVAGLENWVWAEDMVFVPMAVPWSPEHQLQRLQVTRKLLEMEEQAAFLVGSATPRYLYLASNHSNKWGHPRGYRIQMLSFAGEPLPQNSSMARGFSWERIWWPG

SEQ ID NO: 4394 - protein, 312 aa, Homo sapiens
  Payload ID: 983;
  Gene Symbol: AIMP1;
  Gene Name: aminoacyl tRNA synthetase complex-interacting multifunctional prt 1;
  Uniprot ID:  Q12904;
  ENSP ID: ENSP00000350699
MANNDAVLKRLEQKGAEADQIIEYLKQQVSLLKEKAILQATLREEKKLRVENAKLKKEIEELKQELIQAEIQNGVKQIPFPSGTPLHANSMVSENVIQSTAVTTVSSGTKEQIKGGTGDEKKAKEKIEKKGEKKEKKQQSIAGSADSKPIDVSRLDLRIGCIITARKHPDADSLYVEEVDVGEIAPRTVVSGLVNHVPLEQMQNRMVILLCNLKPAKMRGVLSQAMVMCASSPEKIEILAPPNGSVPGDRITFDAFPGEPDKELNPKKKIWEQIQPDLHTNDECVATYKGVPFEVKGKGVCRAQTMSNSGIK

SEQ ID NO: 4395 - protein, 336 aa, Homo sapiens
  Payload ID: 983;
  Gene Symbol: AIMP1;
  Gene Name: aminoacyl tRNA synthetase complex-interacting multifunctional prt 1;
  Uniprot ID:  Q12904;
  ENSP ID: ENSP00000378191
MLPAVAVSEPVVLRFMIFCRLLAKMANNDAVLKRLEQKGAEADQIIEYLKQQVSLLKEKAILQATLREEKKLRVENAKLKKEIEELKQELIQAEIQNGVKQIPFPSGTPLHANSMVSENVIQSTAVTTVSSGTKEQIKGGTGDEKKAKEKIEKKGEKKEKKQQSIAGSADSKPIDVSRLDLRIGCIITARKHPDADSLYVEEVDVGEIAPRTVVSGLVNHVPLEQMQNRMVILLCNLKPAKMRGVLSQAMVMCASSPEKIEILAPPNGSVPGDRITFDAFPGEPDKELNPKKKIWEQIQPDLHTNDECVATYKGVPFEVKGKGVCRAQTMSNSGIK

SEQ ID NO: 4396 - protein, 312 aa, Homo sapiens; identical to SEQ ID NO: 4394
  Payload ID: 983;
  Gene Symbol: AIMP1;
  Gene Name: aminoacyl tRNA synthetase complex-interacting multifunctional prt 1;
  Uniprot ID:  Q12904;
  ENSP ID: ENSP00000405248

SEQ ID NO: 4397 - protein, 150 aa, Homo sapiens
  Payload ID: 983;
  Gene Symbol: AIMP1;
  Gene Name: aminoacyl tRNA synthetase complex-interacting multifunctional prt 1;
  ENSP ID: ENSP00000423681
MANNDAVLKRLEQKGAEADQIIEYLKQQVSLLKEKAILQATLREEKKLRVENAKLKKEIEELKQELIQAEIQNGVKQIPFPSGTPLHANSMVSENVIQSTAVTTVSSGTKEQIKGGTGDEKKAKEKIEKKGEKKEKKQQSIAGSADSKPI

SEQ ID NO: 4398 - protein, 320 aa, Homo sapiens
  Payload ID: 984;
  Gene Symbol: AIMP2;
  Gene Name: aminoacyl tRNA synthetase complex-interacting multifunctional prt 2;
  Uniprot ID:  Q13155;
  ENSP ID: ENSP00000223029
MPMYQVKPYHGGGAPLRVELPTCMYRLPNVHGRSYGPAPGAGHVQEESNLSLQALESRQDDILKRLYELKAAVDGLSKMIQTPDADLDVTNIIQADEPTTLTTNALDLNSVLGKDYGALKDIVINANPASPPLSLLVLHRLLCEHFRVLSTVHTHSSVKSVPENLLKCFGEQNKKQPRQDYQLGFTLIWKNVPKTQMKFSIQTMCPIEGEGNIARFLFSLFGQKHNAVNATLIDSWVDIAIFQLKEGSSKEKAAVFRSMNSALGKSPWLAGNELTVADVVLWSVLQQIGGCSVTVPANVQRWMRSCENLAPFNTALKLLK

SEQ ID NO: 4399 - protein, 251 aa, Homo sapiens
  Payload ID: 984;
  Gene Symbol: AIMP2;
  Gene Name: aminoacyl tRNA synthetase complex-interacting multifunctional prt 2;
  ENSP ID: ENSP00000378658
MPMYQVKPYHGGGAPLRVELPTCMYRLPNVHGRSYGPAPGAGHVQDYGALKDIVINANPASPPLSLLVLHRLLCEHFRVLSTVHTHSSVKSVPENLLKCFGEQNKKQPRQDYQLGFTLIWKNVPKTQMKFSIQTMCPIEGEGNIARFLFSLFGQKHNAVNATLIDSWVDIAIFQLKEGSSKEKAAVFRSMNSALGKSPWLAGNELTVADVVLWSVLQQIGGCSVTVPANVQRWMRSCENLAPFNTALKLLK

SEQ ID NO: 4400 - protein, 242 aa, Homo sapiens
  Payload ID: 984;
  Gene Symbol: AIMP2;
  Gene Name: aminoacyl tRNA synthetase complex-interacting multifunctional prt 2;
  ENSP ID: ENSP00000383327
MIQTPDADLDVTNIIQADEPTTLTTNALDLNSVLGKDYGALKDIVINANPASPPLSLLVLHRLLCEHFRVLSTVHTHSSVKSVPENLLKCFGEQNKKQPRQDYQLGFTLIWKNVPKTQMKFSIQTMCPIEGEGNIARFLFSLFGQKHNAVNATLIDSWVDIAIFQLKEGSSKEKAAVFRSMNSALGKSPWLAGNELTVADVVLWSVLQQIGGCSVTVPANVQRWMRSCENLAPFNTALKLLK

SEQ ID NO: 4401 - protein, 48 aa, Homo sapiens
  Payload ID: 984;
  Gene Symbol: AIMP2;
  Gene Name: aminoacyl tRNA synthetase complex-interacting multifunctional prt 2;
  ENSP ID: ENSP00000392519
MPMYQVKPYHGGGAPLRVELPTCMYRLPNVHGRSYGPAPGAGHVQPLQ

SEQ ID NO: 4402 - protein, 408 aa, Homo sapiens
  Payload ID: 985;
  Gene Symbol: ACY1;
  Gene Name: aminoacylase 1;
  Uniprot ID:  Q03154;
  ENSP ID: ENSP00000384296
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 4403 - protein, 373 aa, Homo sapiens
  Payload ID: 985;
  Gene Symbol: ACY1;
  Gene Name: aminoacylase 1;
  Uniprot ID:  Q03154;
  ENSP ID: ENSP00000417056
MTSKGPEEEHPSVTLFRQYLRIRTVQPKPDYGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 4404 - protein, 336 aa, Homo sapiens
  Payload ID: 985;
  Gene Symbol: ACY1;
  Gene Name: aminoacylase 1;
  Uniprot ID:  Q03154;
  ENSP ID: ENSP00000417618
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 4405 - protein, 201 aa, Homo sapiens
  Payload ID: 985;
  Gene Symbol: ACY1;
  Gene Name: aminoacylase 1;
  ENSP ID: ENSP00000418683
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWCCSQTPT

SEQ ID NO: 4406 - protein, 343 aa, Homo sapiens
  Payload ID: 985;
  Gene Symbol: ACY1;
  Gene Name: aminoacylase 1;
  Uniprot ID:  Q03154;
  ENSP ID: ENSP00000419262
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 4407 - protein, 228 aa, Homo sapiens
  Payload ID: 985;
  Gene Symbol: ACY1;
  Gene Name: aminoacylase 1;
  ENSP ID: ENSP00000419830
MTSKGPEEEHPSVTLFRQYLRIRTVQPKPDYGAAVAFFEETARQLGLGCQKVETTYPPDHLQVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKL

SEQ ID NO: 4408 - protein, 319 aa, Homo sapiens
  Payload ID: 986;
  Gene Symbol: ACY3;
  Gene Name: aminoacylase 3;
  Uniprot ID:  Q96HD9;
  ENSP ID: ENSP00000255082
MCSLPVPREPLRRVAVTGGTHGNEMSGVYLARHWLHAPAELQRASFSAVPVLANPAATSGCRRYVDHDLNRTFTSSFLNSRPTPDDPYEVTRARELNQLLGPKASGQAFDFVLDLHNTTANMGTCLIAKSSHEVFAMHLCRHLQLQYPELSCQVFLYQRSGEESYNLDSVAKNGLGLELGPQPQGVLRADIFSRMRTLVATVLDFIELFNQGTAFPAFEMEAYRPVGVVDFPRTEAGHLAGTVHPQLQDRDFQPLQPGAPIFQMFSGEDLLYEGESTVYPVFINEAAYYEKGVAFVQTEKFTFTVPAMPALTPAPSPAS

SEQ ID NO: 4409 - protein, 198 aa, Homo sapiens
  Payload ID: 986;
  Gene Symbol: ACY3;
  Gene Name: aminoacylase 3;
  ENSP ID: ENSP00000434270
MGTCLIAKSSHEVFAMHLCRHLQLQYPELSCQVFLYQRSGEESYNLDSVAKNGLGLELGPQPQGVLRADIFSRMRTLVATVLDFIELFNQGTAFPAFEMEAYRPVGVVDFPRTEAGHLAGTVHPQLQDRDFQPLQPGAPIFQMFSGEDLLYEGESTVYPVFINEAAYYEKGVAFVQTEKFTFTVPAMPALTPAPSPAS

SEQ ID NO: 4410 - protein, 425 aa, Homo sapiens
  Payload ID: 987;
  Gene Symbol: AADAT;
  Gene Name: aminoadipate aminotransferase;
  Uniprot ID:  Q8N5Z0;
  ENSP ID: ENSP00000226840
MNYARFITAASAARNPSPIRTMTDILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLTSERKKEIYELARKYDFLIIEDDPYYFLQFNKFRVPTFLSMDVDGRVIRADSFSKIISSGLRIGFLTGPKPLIERVILHIQVSTLHPSTFNQLMISQLLHEWGEEGFMAHVDRVIDFYSNQKDAILAAADKWLTGLAEWHVPAAGMFLWIKVKGINDVKELIEEKAVKMGVLMLPGNAFYVDSSAPSPYLRASFSSASPEQMDVAFQVLAQLIKESL

SEQ ID NO: 4411 - protein, 425 aa, Homo sapiens; identical to SEQ ID NO: 4410
  Payload ID: 987;
  Gene Symbol: AADAT;
  Gene Name: aminoadipate aminotransferase;
  Uniprot ID:  Q8N5Z0;
  ENSP ID: ENSP00000336808

SEQ ID NO: 4412 - protein, 209 aa, Homo sapiens
  Payload ID: 987;
  Gene Symbol: AADAT;
  Gene Name: aminoadipate aminotransferase;
  ENSP ID: ENSP00000421389
MNYARFITAASAARNPSPIRTMTDILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLT

SEQ ID NO: 4413 - protein, 429 aa, Homo sapiens
  Payload ID: 987;
  Gene Symbol: AADAT;
  Gene Name: aminoadipate aminotransferase;
  Uniprot ID:  Q8N5Z0;
  ENSP ID: ENSP00000423190
MNYARFITAASAARNPSPIRTMSEKRADILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLTSERKKEIYELARKYDFLIIEDDPYYFLQFNKFRVPTFLSMDVDGRVIRADSFSKIISSGLRIGFLTGPKPLIERVILHIQVSTLHPSTFNQLMISQLLHEWGEEGFMAHVDRVIDFYSNQKDAILAAADKWLTGLAEWHVPAAGMFLWIKVKGINDVKELIEEKAVKMGVLMLPGNAFYVDSSAPSPYLRASFSSASPEQMDVAFQVLAQLIKESL

SEQ ID NO: 4414 - protein, 425 aa, Homo sapiens; identical to SEQ ID NO: 4410
  Payload ID: 987;
  Gene Symbol: AADAT;
  Gene Name: aminoadipate aminotransferase;
  Uniprot ID:  Q8N5Z0;
  ENSP ID: ENSP00000423341

SEQ ID NO: 4415 - protein, 180 aa, Homo sapiens
  Payload ID: 987;
  Gene Symbol: AADAT;
  Gene Name: aminoadipate aminotransferase;
  ENSP ID: ENSP00000423843
MNYARFITAASAARNPSPIRTMTDILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKP

SEQ ID NO: 4416 - protein, 220 aa, Homo sapiens
  Payload ID: 987;
  Gene Symbol: AADAT;
  Gene Name: aminoadipate aminotransferase;
  ENSP ID: ENSP00000425067
MHSVQMGVQWRGPADILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLTSERKKEIYELARKYDFLIIE

SEQ ID NO: 4417 - protein, 1098 aa, Homo sapiens
  Payload ID: 988;
  Gene Symbol: AASDH;
  Gene Name: aminoadipate-semialdehyde dehydrogenase;
  Uniprot ID:  Q4L235;
  ENSP ID: ENSP00000205214
MTLQELVHKAASCYMDRVAVCFDECNNQLPVYYTYKTVVNAASELSNFLLLHCDFQGIREIGLYCQPGIDLPSWILGILQVPAAYVPIEPDSPPSLSTHFMKKCNLKYILVEKKQINKFKSFHETLLNYDTFTVEHNDLVLFRLHWKNTEVNLMLNDGKEKYEKEKIKSISSEHVNEEKAEEHMDLRLKHCLAYVLHTSGTTGIPKIVRVPHKCIVPNIQHFRVLFDITQEDVLFLASPLTFDPSVVEIFLALSSGASLLIVPTSVKLLPSKLASVLFSHHRVTVLQATPTLLRRFGSQLIKSTVLSATTSLRVLALGGEAFPSLTVLRSWRGEGNKTQIFNVYGITEVSSWATIYRIPEKTLNSTLKCELPVQLGFPLLGTVVEVRDTNGFTIQEGSGQVFLGGRNRVCFLDDEVTVPLGTMRATGDFVTVKDGEIFFLGRKDSQIKRHGKRLNIELVQQVAEELQQVESCAVTWYNQEKLILFMVSKDASVKEYIFKELQKYLPSHAVPDELVLIDSLPFTSHGKIDVSELNKIYLNYINLKSENKLSGKEDLWEKLQYLWKSTLNLPEDLLRVPDESLFLNSGGDSLKSIRLLSEIEKLVGTSVPGLLEIILSSSILEIYNHILQTVVPDEDVTFRKSCATKRKLSDINQEEASGTSLHQKAIMTFTCHNEINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGCYNGLVYVLKSNSGEKYWMFTTEDAVKSSATMDPTTGLIYIGSHDQHAYALDIYRKKCVWKSKCGGTVFSSPCLNLIPHHLYFATLGGLLLAVNPATGNVIWKHSCGKPLFSSPQCCSQYICIGCVDGNLLCFTHFGEQVWQFSTSGPIFSSPCTSPSEQKIFFGSHDCFIYCCNMKGHLQWKFETTSRVYATPFAFHNYNGSNEMLLAAASTDGKVWILESQSGQLQSVYELPGEVFSSPVVLESMLIIGCRDNYVYCLDLLGGNQK

SEQ ID NO: 4418 - protein, 857 aa, Homo sapiens
  Payload ID: 988;
  Gene Symbol: AASDH;
  Gene Name: aminoadipate-semialdehyde dehydrogenase;
  Uniprot ID:  Q4L235;
  ENSP ID: ENSP00000409656
MTLQELVHKAASCYMDRVAVCFDECNNQLPVYYTYKTVVNAASELSNFLLLHCDFQGIREIGLYCQPGIDLPSWILGILQVPAAYVPIEPDSPPSLSTHFMKKCNLKYILVEKKQINKFKSFHETLLNYDTFTVEHNDLVLFRLHWKNTEVNLMLNDGKEKYEKEKIKSISSEHVNEEKAEEHMDLRLKHCLAYVLHTSGTTGIPKIVRVPHKCIVPNIQHFRVLFDITQEDVLFLASPLTFDPSVVEIFLALSSGASLLIVPTSVKLLPSKLASVLFSHHRVTVLQATPTLLRRFGSQLIKSTVLSATTSLRVLALGGEAFPSLTVLRSWRGEGNKTQIFNVYGITEVSSWATIYRIPEKTLNSTLKCELPVQLGFPLLGTVVEVRDTNGFTIQEGSGQVFLGGRNRVCFLDDEVTVPLGTMRATGDFVTVKDGEIFFLGRKDSQIKRHGKRLNIELVQQVAEELQQVESCAVTWYNQEKLILFMVSKDASVKEYIFKELQKYLPSHAVPDELVLIDSLPFTSHGKIDVSELNKIYLNYINLKSENKLSGKEDLWEKLQYLWKSTLNLPEDLLRVPDESLFLNSGGDSLKSIRLLSEIEKLVGTSVPGLLEIILSSSILEIYNHILQTVVPDEDVTFRKSCATKRKLSDINQEEASGTSLHQKAIMTFTCHNEINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGLAVLYQWTNLFIPVYLTIRAKNIFWFP

SEQ ID NO: 4419 - protein, 841 aa, Homo sapiens
  Payload ID: 988;
  Gene Symbol: AASDH;
  Gene Name: aminoadipate-semialdehyde dehydrogenase;
  Uniprot ID:  Q4L235;
  ENSP ID: ENSP00000421171
MTLQELVHKAASCYMDRVAVCFDECNNQLPVYYTYKTVVNAASELSNFLLLHCDFQGIREIGLYCQPGIDLPSWILGILQVPAAYVPIEPDSPPSLSTHFMKKCNLKYILVEKKQINKFKSFHETLLNYDTFTVEHNDLVLFRLHWKNTEVNLMLNDGKEKYEKEKIKSISSEHVNEEKAEEHMDLRLKHCLAYVLHTSGTTGIPKIVRVPHKCIVPNIQHFRVLFDITQEDVLFLASPLTFDPSVVEIFLALSSGASLLIVPTSVKLLPSKLASVLFSHHRVTVLQATPTLLRRFGSQLIKSTVLSATTSLRVLALGGEAFPSLTVLRSWRGEGNKTQIFNVYGITEVSSWATIYRIPEKTLNSTLKCELPVQLGFPLLGTVVEVRDTNGFTIQEGSGQVFLGGRNRVCFLDDEVTVPLGTMRATGDFVTVKDGEIFFLGRKDSQIKRHGKRLNIELVQQVAEELQQVESCAVTWYNQEKLILFMVSKDASVKEYIFKELQKYLPSHAVPDELVLIDSLPFTSHGKIDVSELNKIYLNYINLKSENKLSGKEDLWEKLQYLWKSTLNLPEDLLRVPDESLFLNSGGDSLKSIRLLSEIEKLVGTSVPGLLEIILSSSILEIYNHILQTVVPDEDVTFRKSCATKRKLSDINQEEASGTSLHQKAIMTFTCHNEINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGKFLNLRFVELN

SEQ ID NO: 4420 - protein, 86 aa, Homo sapiens
  Payload ID: 988;
  Gene Symbol: AASDH;
  Gene Name: aminoadipate-semialdehyde dehydrogenase;
  ENSP ID: ENSP00000421658
MTLQELVHKAASCYMDRVAVCFDECNNQLPVYYTYKTVVNAASELSNFLLLHCDFQGIREIGLYCQPGIDLPSWILGNLNLFMKHY

SEQ ID NO: 4421 - protein, 998 aa, Homo sapiens
  Payload ID: 988;
  Gene Symbol: AASDH;
  Gene Name: aminoadipate-semialdehyde dehydrogenase;
  Uniprot ID:  Q4L235;
  ENSP ID: ENSP00000423760
MKKCNLKYILVEKKQINKFKSFHETLLNYDTFTVEHNDLVLFRLHWKNTEVNLMLNDGKEKYEKEKIKSISSEHVNEEKAEEHMDLRLKHCLAYVLHTSGTTGIPKIVRVPHKCIVPNIQHFRVLFDITQEDVLFLASPLTFDPSVVEIFLALSSGASLLIVPTSVKLLPSKLASVLFSHHRVTVLQATPTLLRRFGSQLIKSTVLSATTSLRVLALGGEAFPSLTVLRSWRGEGNKTQIFNVYGITEVSSWATIYRIPEKTLNSTLKCELPVQLGFPLLGTVVEVRDTNGFTIQEGSGQVFLGGRNRVCFLDDEVTVPLGTMRATGDFVTVKDGEIFFLGRKDSQIKRHGKRLNIELVQQVAEELQQVESCAVTWYNQEKLILFMVSKDASVKEYIFKELQKYLPSHAVPDELVLIDSLPFTSHGKIDVSELNKIYLNYINLKSENKLSGKEDLWEKLQYLWKSTLNLPEDLLRVPDESLFLNSGGDSLKSIRLLSEIEKLVGTSVPGLLEIILSSSILEIYNHILQTVVPDEDVTFRKSCATKRKLSDINQEEASGTSLHQKAIMTFTCHNEINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGCYNGLVYVLKSNSGEKYWMFTTEDAVKSSATMDPTTGLIYIGSHDQHAYALDIYRKKCVWKSKCGGTVFSSPCLNLIPHHLYFATLGGLLLAVNPATGNVIWKHSCGKPLFSSPQCCSQYICIGCVDGNLLCFTHFGEQVWQFSTSGPIFSSPCTSPSEQKIFFGSHDCFIYCCNMKGHLQWKFETTSRVYATPFAFHNYNGSNEMLLAAASTDGKVWILESQSGQLQSVYELPGEVFSSPVVLESMLIIGCRDNYVYCLDLLGGNQK

SEQ ID NO: 4422 - protein, 120 aa, Homo sapiens
  Payload ID: 988;
  Gene Symbol: AASDH;
  Gene Name: aminoadipate-semialdehyde dehydrogenase;
  ENSP ID: ENSP00000427298
MTLQELVHKAASCYMDRVAVCFDECNNQLPVYYTYKTVVNAASELSNFLLLHCDFQGIREIGLYCQPGIDLPSWILGILQVPAAYVPIEPDSPPSLSTHFMKKCNLKYILVEKKQINGTF

SEQ ID NO: 4423 - protein, 945 aa, Homo sapiens
  Payload ID: 988;
  Gene Symbol: AASDH;
  Gene Name: aminoadipate-semialdehyde dehydrogenase;
  ENSP ID: ENSP00000473564
MLNDGKEKYEKEKIKSISSEHVNEEKAEEHMDLRLKHCLAYVLHTSGTTGIPKIVRVPHKCIVPNIQHFRVLFDITQEDVLFLASPLTFDPSVVEIFLALSSGASLLIVPTSVKLLPSKLASVLFSHHRVTVLQATPTLLRRFGSQLIKSTVLSATTSLRVLALGGEAFPSLTVLRSWRGEGNKTQIFNVYGITEVSSWATIYRIPEKTLNSTLKCELPVQLGFPLLGTVVEVRDTNGFTIQEGSGQVFLGGRNRVCFLDDEVTVPLGTMRATGDFVTVKDGEIFFLGRKDSQIKRHGKRLNIELVQQVAEELQQVESCAVTWYNQEKLILFMVSKDASVKEYIFKELQKYLPSHAVPDELVLIDSLPFTSHGKIDVSELNKIYLNYINLKSENKLSGKEDLWEKLQYLWKSTLNLPEDLLRVPDESLFLNSGGDSLKSIRLLSEIEKLVGTSVPGLLEIILSSSILEIYNHILQTVVPDEDVTFRKSCATKRKLSDINQEEASGTSLHQKAIMTFTCHNEINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGCYNGLVYVLKSNSGEKYWMFTTEDAVKSSATMDPTTGLIYIGSHDQHAYALDIYRKKCVWKSKCGGTVFSSPCLNLIPHHLYFATLGGLLLAVNPATGNVIWKHSCGKPLFSSPQCCSQYICIGCVDGNLLCFTHFGEQVWQFSTSGPIFSSPCTSPSEQKIFFGSHDCFIYCCNMKGHLQWKFETTSRVYATPFAFHNYNGSNEMLLAAASTDGKVWILESQSGQLQSVYELPGEVFSSPVVLESMLIIGCRDNYVYCLDLLGGNQK

SEQ ID NO: 4424 - protein, 309 aa, Homo sapiens
  Payload ID: 989;
  Gene Symbol: AASDHPPT;
  Gene Name: aminoadipate-semialdehyde dehydrogenase-phosphopantetheinyl transferase;
  Uniprot ID:  Q9NRN7;
  ENSP ID: ENSP00000278618
MVFPAKRFCLVPSMEGVRWAFSCGTWLPSRAEWLLAVRSIQPEEKERIGQFVFARDAKAAMAGRLMIRKLVAEKLNIPWNHIRLQRTAKGKPVLAKDSSNPYPNFNFNISHQGDYAVLAAEPELQVGIDIMKTSFPGRGSIPEFFHIMKRKFTNKEWETIRSFKDEWTQLDMFYRNWALKESFIKAIGVGLGFELQRLEFDLSPLNLDIGQVYKETRLFLDGEEEKEWAFEESKIDEHHFVAVALRKPDGSRHQDVPSQDDSKPTQRQFTILNFNDLMSSAVPMTPEDPSFWDCFCFTEEIPIRNGTKS

SEQ ID NO: 4425 - protein, 190 aa, Homo sapiens
  Payload ID: 989;
  Gene Symbol: AASDHPPT;
  Gene Name: aminoadipate-semialdehyde dehydrogenase-phosphopantetheinyl transferase;
  ENSP ID: ENSP00000435099
MIRKLVAEKLNIPWNHIRLQRTAKGKPVLAKDSSNPYPNFNFNISHQGDYAVLAAEPELQVGIDIMKTSFPGRGSIPEFFHIMKRKFTNKEWETIRSFKDEWTQLDMFYRNWALKESFIKAIGVGLGFELQRLEFDLSPLNLDIGQVYKETRLFLDGEEEKEWAFEESKIDEHHFVAVALRKPDGSRHQD

SEQ ID NO: 4426 - protein, 138 aa, Homo sapiens
  Payload ID: 989;
  Gene Symbol: AASDHPPT;
  Gene Name: aminoadipate-semialdehyde dehydrogenase-phosphopantetheinyl transferase;
  Uniprot ID:  Q9NRN7;
  ENSP ID: ENSP00000437144
MVFPAKRFCLVPSMEGVRWAFSCGTWLPSRAEWLLAVRSIQPEEKERIGQFVFARDAKAAMAGRLMIRKLVAEKLNIPWNHIRLQRTAKGKPVLAKDSSNPYPNFNFNISHQGDYAVLAAEPELQVGIDIMKTSFPGT

SEQ ID NO: 4427 - protein, 160 aa, Homo sapiens
  Payload ID: 989;
  Gene Symbol: AASDHPPT;
  Gene Name: aminoadipate-semialdehyde dehydrogenase-phosphopantetheinyl transferase;
  ENSP ID: ENSP00000437175
MIRKLVAEKLNIPWNHIRLQRTAKGKPVLAKDSSNPYPNFNFNISHQGDYAVLAAEPELQVGIDIMKTSFPGRGSIPEFFHIMKRKFTNKEWETIRSFKDEWTQLDMFYRNWALKESFIKAIGVGLGFELQRLEFDLSPLNLDIGQVYKETRLFLDGEEE

SEQ ID NO: 4428 - protein, 732 aa, Homo sapiens
  Payload ID: 990;
  Gene Symbol: AASS;
  Gene Name: aminoadipate-semialdehyde synthase;
  ENSP ID: ENSP00000351834
MLQVHRTGLGRLGVSLSKGLHHKAVLAVRREDVNAWERRAPLAPKHIKGITNLGYKVLIQPSNRRAIHDKDYVKAGGILQEDISEACLILGVKRPPEEKLMSRKTYAFFSHTIKAQEANMGLLDEILKQEIRLIDYEKMVDHRGVRVVAFGQWAGVAGMINILHGMGLRLLALGHHTPFMHIGMAHNYRNSSQAVQAVRDAGYEISLGLMPKSIGPLTFVFTGTGNVSKGAQAIFNELPCEYVEPHELKEVSQTGDLRKVYGTVLSRHHHLVRKTDAVYDPAEYDKHPERYISRFNTDIAPYTTCLINGIYWEQNTPRLLTRQDAQSLLAPGKFSPAGVEGCPALPHKLVAICDISADTGGSIEFMTECTTIEHPFCMYDADQHIIHDSVEGSGILMCSIDNLPAQLPIEATECFGDMLYPYVEEMILSDATQPLESQNFSPVVRDAVITSNGTLPDKYKYIQTLRESRERAQSLSMGTRRKVLVLGSGYISEPVLEYLSRDGNIEITVGSDMKNQIEQLGKKYNINPVSMDICKQEEKLGFLVAKQDLVISLLPYVLHPLVAKACITNKVNMVTASYITPALKELEKSVEDAGITIIGELGLDPGLDHMLAMETIDKAKEVGATIESYISYCGGLPAPEHSNNPLRYKFSWSPVGVLMNVMQSATYLLDGKVVNVAGGISFLDAVTSMDFFPGLNLEGYPNRDSTKYAEIYGISSAHTLLRGTLRYKGLEC

SEQ ID NO: 4429 - protein, 926 aa, Homo sapiens
  Payload ID: 990;
  Gene Symbol: AASS;
  Gene Name: aminoadipate-semialdehyde synthase;
  Uniprot ID:  Q9UDR5;
  ENSP ID: ENSP00000377040
MLQVHRTGLGRLGVSLSKGLHHKAVLAVRREDVNAWERRAPLAPKHIKGITNLGYKVLIQPSNRRAIHDKDYVKAGGILQEDISEACLILGVKRPPEEKLMSRKTYAFFSHTIKAQEANMGLLDEILKQEIRLIDYEKMVDHRGVRVVAFGQWAGVAGMINILHGMGLRLLALGHHTPFMHIGMAHNYRNSSQAVQAVRDAGYEISLGLMPKSIGPLTFVFTGTGNVSKGAQAIFNELPCEYVEPHELKEVSQTGDLRKVYGTVLSRHHHLVRKTDAVYDPAEYDKHPERYISRFNTDIAPYTTCLINGIYWEQNTPRLLTRQDAQSLLAPGKFSPAGVEGCPALPHKLVAICDISADTGGSIEFMTECTTIEHPFCMYDADQHIIHDSVEGSGILMCSIDNLPAQLPIEATECFGDMLYPYVEEMILSDATQPLESQNFSPVVRDAVITSNGTLPDKYKYIQTLRESRERAQSLSMGTRRKVLVLGSGYISEPVLEYLSRDGNIEITVGSDMKNQIEQLGKKYNINPVSMDICKQEEKLGFLVAKQDLVISLLPYVLHPLVAKACITNKVNMVTASYITPALKELEKSVEDAGITIIGELGLDPGLDHMLAMETIDKAKEVGATIESYISYCGGLPAPEHSNNPLRYKFSWSPVGVLMNVMQSATYLLDGKVVNVAGGISFLDAVTSMDFFPGLNLEGYPNRDSTKYAEIYGISSAHTLLRGTLRYKGYMKALNGFVKLGLINREALPAFRPEANPLTWKQLLCDLVGISPSSEHDVLKEAVLKKLGGDNTQLEAAEWLGLLGDEQVPQAESILDALSKHLVMKLSYGPEEKDMIVMRDSFGIRHPSGHLEHKTIDLVAYGDINGFSAMAKTVGLPTAMAAKMLLDGEIGAKGLMGPFSKEIYGPILERIKAEGIIYTTQSTIKP

SEQ ID NO: 4430 - protein, 21 aa, Homo sapiens
  Payload ID: 990;
  Gene Symbol: AASS;
  Gene Name: aminoadipate-semialdehyde synthase;
  ENSP ID: ENSP00000394180
WIGMLNNVEYLPMVSSLTPSP

SEQ ID NO: 4431 - protein, 926 aa, Homo sapiens; identical to SEQ ID NO: 4429
  Payload ID: 990;
  Gene Symbol: AASS;
  Gene Name: aminoadipate-semialdehyde synthase;
  Uniprot ID:  Q9UDR5;
  ENSP ID: ENSP00000403768

SEQ ID NO: 4432 - protein, 511 aa, Homo sapiens
  Payload ID: 990;
  Gene Symbol: AASS;
  Gene Name: aminoadipate-semialdehyde synthase;
  ENSP ID: ENSP00000414001
MLQVHRTGLGRLGVSLSKGLHHKAVLAVRREDVNAWERRAPLAPKHIKGITNLGYKVLIQPSNRRAIHDKDYVKAGGILQEDISEACLILGVKRPPEEKLMSRKTYAFFSHTIKAQEANMGLLDEILKQEIRLIDYEKMVDHRGVRVVAFGQWAGVAGMINILHGMGLRLLALGHHTPFMHIGMAHNYRNSSQAVQAVRDAGYEISLGLMPKSIGPLTFVFTGTGNVSKGAQAIFNELPCEYVEPHELKEVSQTGDLRKVYGTVLSRHHHLVRKTDAVYDPAEYDKHPERYISRFNTDIAPYTTCLINGIYWEQNTPRLLTRQDAQSLLAPGKFSPAGVEGCPALPHKLVAICDISADTGGSIEFMTECTTIEHPFCMYDADQHIIHDSVEGSGILMCSIDNLPAQLPIEATECFGDMLYPYVEEMILSDATQPLESQNFSPVVRDAVITSNGTLPDKYKYIQTLRESRERAQSLSMGTRRKVLVLGSGYISEPVLEYLSRDGNIEITDLT

SEQ ID NO: 4433 - protein, 336 aa, Homo sapiens
  Payload ID: 991;
  Gene Symbol: ACMSD;
  Gene Name: aminocarboxymuconate semialdehyde decarboxylase;
  Uniprot ID:  Q8TDX5;
  ENSP ID: ENSP00000348459
MKIDIHSHILPKEWPDLKKRFGYGGWVQLQHHSKGEAKLLKDGKVFRVVRENCWDPEVRIREMDQKGVTVQALSTVPVMFSYWAKPEDTLNLCQLLNNDLASTVVSYPRRFVGLGTLPMQAPELAVKEMERCVKELGFPGVQIGTHVNEWDLNAQELFPVYAAAERLKCSLFVHPWDMQMDGRMAKYWLPWLVGMPAETTIAICSMIMGGVFEKFPKLKVCFAHGGGAFPFTVGRISHGFSMRPDLCAQDNPMNPKKYLGSFYTDALVHDPLSLKLLTDVIGKDKVILGTDYPFPLGELEPGKLIESMEEFDEETKNKLKAGNALAFLGLERKQFE

SEQ ID NO: 4434 - protein, 278 aa, Homo sapiens
  Payload ID: 991;
  Gene Symbol: ACMSD;
  Gene Name: aminocarboxymuconate semialdehyde decarboxylase;
  Uniprot ID:  Q8TDX5;
  ENSP ID: ENSP00000376659
MGKSSEWCERIAGIQKFVLEKWTKKAKPEDTLNLCQLLNNDLASTVVSYPRRFVGLGTLPMQAPELAVKEMERCVKELGFPGVQIGTHVNEWDLNAQELFPVYAAAERLKCSLFVHPWDMQMDGRMAKYWLPWLVGMPAETTIAICSMIMGGVFEKFPKLKVCFAHGGGAFPFTVGRISHGFSMRPDLCAQDNPMNPKKYLGSFYTDALVHDPLSLKLLTDVIGKDKVILGTDYPFPLGELEPGKLIESMEEFDEETKNKLKAGNALAFLGLERKQFE

SEQ ID NO: 4435 - protein, 330 aa, Homo sapiens
  Payload ID: 992;
  Gene Symbol: ALAD;
  Gene Name: aminolevulinate dehydratase;
  Uniprot ID:  P13716;
  ENSP ID: ENSP00000386284
MQPQSVLHSGYFHPLLRAWQTATTTLNASNLIYPIFVTDVPDDIQPITSLPGVARYGVKRLEEMLRPLVEEGLRCVLIFGVPSRVPKDERGSAADSEESPAIEAIHLLRKTFPNLLVACDVCLCPYTSHGHCGLLSENGAFRAEESRQRLAEVALAYAKAGCQVVAPSDMMDGRVEAIKEALMAHGLGNRVSVMSYSAKFASCFYGPFRDAAKSSPAFGDRRCYQLPPGARGLALRAVDRDVREGADMLMVKPGMPYLDIVREVKDKHPDLPLAVYHVSGEFAMLWHGAQAGAFDLKAAVLEAMTAFRRAGADIIITYYTPQLLQWLKEE

SEQ ID NO: 4436 - protein, 120 aa, Homo sapiens
  Payload ID: 992;
  Gene Symbol: ALAD;
  Gene Name: aminolevulinate dehydratase;
  ENSP ID: ENSP00000392748
MPLCPLAHAMQPQSVLHSGYFHPLLRAWQTATTTLNASNLIYPIFVTDVPDDIQPITSLPGVARYGVKRLEEMLRPLVEEGLRCVLIFGVPSRVPKDERGSAADSEESPAIEAIHLLRKT

SEQ ID NO: 4437 - protein, 14 aa, Homo sapiens
  Payload ID: 992;
  Gene Symbol: ALAD;
  Gene Name: aminolevulinate dehydratase;
  ENSP ID: ENSP00000398438
MPLCPLAHAMQPQS

SEQ ID NO: 4438 - protein, 59 aa, Homo sapiens
  Payload ID: 992;
  Gene Symbol: ALAD;
  Gene Name: aminolevulinate dehydratase;
  ENSP ID: ENSP00000415737
MPLCPLAHAMQPQSVLHSGYFHPLLRAWQTATTTLNASNLIYPIFVTDVPDDIQPITSL

SEQ ID NO: 4439 - protein, 403 aa, Homo sapiens
  Payload ID: 993;
  Gene Symbol: AMT;
  Gene Name: amino methyltransferase;
  Uniprot ID:  P48728;
  ENSP ID: ENSP00000273588
MQRAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVEVRRKQQMAVVSKMPFVPTNYYTLK

SEQ ID NO: 4440 - protein, 386 aa, Homo sapiens
  Payload ID: 993;
  Gene Symbol: AMT;
  Gene Name: amino methyltransferase;
  Uniprot ID:  P48728;
  ENSP ID: ENSP00000378747
MQRAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVELPSGPCF

SEQ ID NO: 4441 - protein, 262 aa, Homo sapiens
  Payload ID: 993;
  Gene Symbol: AMT;
  Gene Name: amino methyltransferase;
  ENSP ID: ENSP00000388068
MQRAVSVVARLGFRLQAFPPALCRPLSCAQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQR

SEQ ID NO: 4442 - protein, 39 aa, Homo sapiens
  Payload ID: 993;
  Gene Symbol: AMT;
  Gene Name: amino methyltransferase;
  ENSP ID: ENSP00000399943
MQRAVSVVARLGFRLQAFPPALCRPLSCAQWSTPWLCLL

SEQ ID NO: 4443 - protein, 384 aa, Homo sapiens
  Payload ID: 993;
  Gene Symbol: AMT;
  Gene Name: amino methyltransferase;
  ENSP ID: ENSP00000403821
  MOD_RES (1)..(1): Any amino acid
XAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVELPSGPCF

SEQ ID NO: 4444 - protein, 359 aa, Homo sapiens
  Payload ID: 993;
  Gene Symbol: AMT;
  Gene Name: amino methyltransferase;
  Uniprot ID:  P48728;
  ENSP ID: ENSP00000415619
MQRAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVEVRRKQQMAVVSKMPFVPTNYYTLK

SEQ ID NO: 4445 - protein, 347 aa, Homo sapiens
  Payload ID: 993;
  Gene Symbol: AMT;
  Gene Name: amino methyltransferase;
  Uniprot ID:  P48728;
  ENSP ID: ENSP00000443200
MQRAVSVVARLGFRLQAFPPALCRPLSCAQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVEVRRKQQMAVVSKMPFVPTNYYTLK

SEQ ID NO: 4446 - protein, 919 aa, Homo sapiens
  Payload ID: 994;
  Gene Symbol: NPEPPS;
  Gene Name: aminopeptidase puromycin sensitive;
  Uniprot ID:  P55786;
  ENSP ID: ENSP00000320324
MWLAAAAPSLARRLLFLGPPPPPLLLLVFSRSSRRRLHSLGLAAMPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 4447 - protein, 65 aa, Homo sapiens
  Payload ID: 994;
  Gene Symbol: NPEPPS;
  Gene Name: aminopeptidase puromycin sensitive;
  ENSP ID: ENSP00000432127
  MOD_RES (1)..(1): Any amino acid
XKNVKPDQWVKLNLGTVGFYRTQYSSAMLESLLPGIRDLSLPPVDRLGLQNDLFSLTSMRKSRSL

SEQ ID NO: 4448 - protein, 915 aa, Homo sapiens
  Payload ID: 994;
  Gene Symbol: NPEPPS;
  Gene Name: aminopeptidase puromycin sensitive;
  ENSP ID: ENSP00000433287
MASFSMDCSPSFCVPGLWNPFIIFRSRSSRRRLHSLGLAAMPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 4449 - protein, 169 aa, Homo sapiens
  Payload ID: 994;
  Gene Symbol: NPEPPS;
  Gene Name: aminopeptidase puromycin sensitive;
  ENSP ID: ENSP00000433549
LHKQADMQEEKNRIERVLGATLLPDLIQKVLTFALSEEVRPQDTVSVIGGVAGGSKHGRKAAWKFIKDNWEELYNRYQGGFLISRLIKVQWLTPVIPALWDAELSVEGFAVDKMAGEVKAFFESHPAPSAERTIQQCCENILLNAAWLKRDAESIHQYLLQRKASPPTV

SEQ ID NO: 4450 - protein, 141 aa, Homo sapiens
  Payload ID: 994;
  Gene Symbol: NPEPPS;
  Gene Name: aminopeptidase puromycin sensitive;
  ENSP ID: ENSP00000433649
SRSSRRRLHSLGLAAMPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRINAWLVAWH

SEQ ID NO: 4451 - protein, 134 aa, Homo sapiens
  Payload ID: 994;
  Gene Symbol: NPEPPS;
  Gene Name: aminopeptidase puromycin sensitive;
  ENSP ID: ENSP00000433735
MASFSMDCSPSFCVPGLWNPFIIFRSRSSRRRLHSLGLAAMPEKRPFERLPADVSPINYSLCLKPDLLDFTFEGKLEAAAQVRQATNQIVMNCADIDIITASYAPEGDEVSGLQMFRSLITFHLWTAFLLVHLS

SEQ ID NO: 4452 - protein, 178 aa, Homo sapiens
  Payload ID: 994;
  Gene Symbol: NPEPPS;
  Gene Name: aminopeptidase puromycin sensitive;
  ENSP ID: ENSP00000434554
MASFSMDCSPSFCVPGLWNPFIIFRSRSSRRRLHSLGLAAMPEKRPFERLPADVSPINYSLCLKPDLLDFTFEGKLEAAAQVRQATNQIVMNCADIDIITASYAPEGDEEIHATGFNYQNEDEKVTLSFPSTLQTGNNSFQYFVFCLVCHFLEVVTVNILLWFDGLGDLKPSKSVREP

SEQ ID NO: 4453 - protein, 163 aa, Homo sapiens
  Payload ID: 994;
  Gene Symbol: NPEPPS;
  Gene Name: aminopeptidase puromycin sensitive;
  ENSP ID: ENSP00000434585
MWLAAAAPSLARRLLFLGPPPPPLLLLVFSRSSRRRLHSLGLAAMPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSY

SEQ ID NO: 4454 - protein, 158 aa, Homo sapiens
  Payload ID: 994;
  Gene Symbol: NPEPPS;
  Gene Name: aminopeptidase puromycin sensitive;
  ENSP ID: ENSP00000435639
MENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAAT

SEQ ID NO: 4455 - protein, 172 aa, Homo sapiens
  Payload ID: 994;
  Gene Symbol: NPEPPS;
  Gene Name: aminopeptidase puromycin sensitive;
  ENSP ID: ENSP00000435966
MENWGLVTYSSFIAIYPAWRTFPNFISSSQVFTCLSPQHKHWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAAT

SEQ ID NO: 4456 - protein, 127 aa, Homo sapiens
  Payload ID: 994;
  Gene Symbol: NPEPPS;
  Gene Name: aminopeptidase puromycin sensitive;
  ENSP ID: ENSP00000436733
MENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEYYRLSASCHNPESHCLPGQCGPSI

SEQ ID NO: 4457 - protein, 201 aa, Homo sapiens
  Payload ID: 994;
  Gene Symbol: NPEPPS;
  Gene Name: aminopeptidase puromycin sensitive;
  ENSP ID: ENSP00000437019
MASFSMDCSPSFCVPGLWNPFIIFRSLGLAAMPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALS

SEQ ID NO: 4458 - protein, 523 aa, Homo sapiens
  Payload ID: 995;
  Gene Symbol: NPEPL1;
  Gene Name: aminopeptidase-like 1;
  Uniprot ID:  Q8NDH3;
  ENSP ID: ENSP00000348395
MANVGLQFQASAGDSDPQSRPLLLLGQLHHLHRVPWSHVRGKLQPRVTEELWQAALSTLNPNPTDSCPLYLNYATVAALPCRVSRHNSPSAAHFITRLVRTCLPPGAHRCIVMVCEQPEVFASACALARAFPLFTHRSGASRRLEKKTVTVEFFLVGQDNGPVEVSTLQCLANATDGVRLAARIVDTPCNEMNTDTFLEEINKVGKELGIIPTIIRDEELKTRGFGGIYGVGKAALHPPALAVLSHTPDGATQTIAWVGKGIVYDTGGLSIKGKTTMPGMKRDCGGAAAVLGAFRAAIKQGFKDNLHAVFCLAENSVGPNATRPDDIHLLYSGKTVEINNTDAEGRLVLADGVSYACKDLGADIILDMATLTGAQGIATGKYHAAVLTNSAEWEAACVKAGRKCGDLVHPLVYCPELHFSEFTSAVADMKNSVADRDNSPSSCAGLFIASHIGFDWPGVWVHLDIAAPVHAGERATGFGVALLLALFGRASEDPLLNLVSPLGCEVDVEEGDLGRDSKRRRLV

SEQ ID NO: 4459 - protein, 495 aa, Homo sapiens
  Payload ID: 995;
  Gene Symbol: NPEPL1;
  Gene Name: aminopeptidase-like 1;
  Uniprot ID:  Q8NDH3;
  ENSP ID: ENSP00000434810
MELHGGNRGGYQPKALEQSGCWLWQAALSTLNPNPTDSCPLYLNYATVAALPCRVSRHNSPSAAHFITRLVRTCLPPGAHRCIVMVCEQPEVFASACALARAFPLFTHRSGASRRLEKKTVTVEFFLVGQDNGPVEVSTLQCLANATDGVRLAARIVDTPCNEMNTDTFLEEINKVGKELGIIPTIIRDEELKTRGFGGIYGVGKAALHPPALAVLSHTPDGATQTIAWVGKGIVYDTGGLSIKGKTTMPGMKRDCGGAAAVLGAFRAAIKQGFKDNLHAVFCLAENSVGPNATRPDDIHLLYSGKTVEINNTDAEGRLVLADGVSYACKDLGADIILDMATLTGAQGIATGKYHAAVLTNSAEWEAACVKAGRKCGDLVHPLVYCPELHFSEFTSAVADMKNSVADRDNSPSSCAGLFIASHIGFDWPGVWVHLDIAAPVHAGERATGFGVALLLALFGRASEDPLLNLVSPLGCEVDVEEGDLGRDSKRRRLV

SEQ ID NO: 4460 - protein, 180 aa, Homo sapiens
  Payload ID: 995;
  Gene Symbol: NPEPL1;
  Gene Name: aminopeptidase-like 1;
  ENSP ID: ENSP00000436265
  MOD_RES (1)..(1): Any amino acid
XMVCEQPEVFASACALARAFPLFTHRSGASRRLEKKTVTVEFFLVGQDNGPVEVSTLQCLANATDGVRLAARIVDTPCNEMNTDTFLEEINKVGKELGIIPTIIRDEELKTRGFGGIYGVGKAALHPPALAVLSHTPDGATQTIAWVGKGIVYDTGGLSIKGKRARKRIQWLPDLFGTVA

SEQ ID NO: 4461 - protein, 475 aa, Homo sapiens
  Payload ID: 995;
  Gene Symbol: NPEPL1;
  Gene Name: aminopeptidase-like 1;
  Uniprot ID:  Q8NDH3;
  ENSP ID: ENSP00000437112
MELWQAALSTLNPNPTDSCPLYLNYATVAALPCRVSRHNSPSAAHFITRLVRTCLPPGAHRCIVMVCEQPEVFASACALARAFPLFTHRSGASRRLEKKTVTVEFFLVGQDNGPVEVSTLQCLANATDGVRLAARIVDTPCNEMNTDTFLEEINKVGKELGIIPTIIRDEELKTRGFGGIYGVGKAALHPPALAVLSHTPDGATQTIAWVGKGIVYDTGGLSIKGKTTMPGMKRDCGGAAAVLGAFRAAIKQGFKDNLHAVFCLAENSVGPNATRPDDIHLLYSGKTVEINNTDAEGRLVLADGVSYACKDLGADIILDMATLTGAQGIATGKYHAAVLTNSAEWEAACVKAGRKCGDLVHPLVYCPELHFSEFTSAVADMKNSVADRDNSPSSCAGLFIASHIGFDWPGVWVHLDIAAPVHAGERATGFGVALLLALFGRASEDPLLNLVSPLGCEVDVEEGDLGRDSKRRRLV

SEQ ID NO: 4462 - protein, 264 aa, Homo sapiens
  Payload ID: 996;
  Gene Symbol: AES;
  Gene Name: amino-terminal enhancer of split;
  Uniprot ID:  Q08117;
  ENSP ID: ENSP00000221561
MCHKNGFPQEGGITAAFLQKRKLRLSKNHRPARAKVTEHVRGTRPGRATAGPAASTRAAGSLFFDRWGNRGPAGCRGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 4463 - protein, 197 aa, Homo sapiens
  Payload ID: 996;
  Gene Symbol: AES;
  Gene Name: amino-terminal enhancer of split;
  Uniprot ID:  Q08117;
  ENSP ID: ENSP00000317537
MMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 4464 - protein, 264 aa, Homo sapiens
  Payload ID: 996;
  Gene Symbol: AES;
  Gene Name: amino-terminal enhancer of split;
  ENSP ID: ENSP00000466038
  MOD_RES (1)..(1): Any amino acid
XAFLQKRKLRLSKNHRPARAKVTEHVRGTRPGRATAGPAASTRAAGSLFFDRWGNRGPAGCRGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRVCMGTWAGGRGTGGPQAANVPLPRPAAAAPSPPAVPAAGPGPALDPTTRGAAAAFAAGGQRRHRPPLAVRAGFPGPPLQGRQERARW

SEQ ID NO: 4465 - protein, 48 aa, Homo sapiens
  Payload ID: 996;
  Gene Symbol: AES;
  Gene Name: amino-terminal enhancer of split;
  ENSP ID: ENSP00000466179
MMFPQSRHSGSSHLPQQLKFTTSDSCDRIKDEFQLLQAQYHRLRSSKG

SEQ ID NO: 4466 - protein, 141 aa, Homo sapiens
  Payload ID: 996;
  Gene Symbol: AES;
  Gene Name: amino-terminal enhancer of split;
  ENSP ID: ENSP00000467831
MQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 4467 - protein, 310 aa, Homo sapiens
  Payload ID: 997;
  Gene Symbol: AMMECR1L;
  Gene Name: AMMECR 1-like;
  Uniprot ID:  Q6DCA0;
  ENSP ID: ENSP00000272647
MGKRRCVPPLEPKLAAGCCGVKKPKLSGSGTHSHGNQSTTVPGSSSGPLQNHQHVDSSSGRENVSDLTLGPGNSPITRMNPASGALSPLPRPNGTANTTKNLVVTAEMCCYCFDVLYCHLYGFPQPRLPRFTNDPYPLFVTWKTGRDKRLRGCIGTFSAMNLHSGLREYTLTSALKDSRFPPLTREELPKLFCSVSLLTNFEDASDYLDWEVGVHGIRIEFINEKGVKRTATYLPEVAKEQDWDQIQTIDSLLRKGGFKAPITSEFRKTIKLTRYRSEKVTISYAEYIASRQHCFQNGTLHAPPLYNHYS

SEQ ID NO: 4468 - protein, 310 aa, Homo sapiens; identical to SEQ ID NO: 4467
  Payload ID: 997;
  Gene Symbol: AMMECR1L;
  Gene Name: AMMECR 1-like;
  Uniprot ID:  Q6DCA0;
  ENSP ID: ENSP00000376726

SEQ ID NO: 4469 - protein, 453 aa, Homo sapiens
  Payload ID: 998;
  Gene Symbol: AMN;
  Gene Name: amnion associated transmembrane prt;
  Uniprot ID:  Q9BXJ7;
  ENSP ID: ENSP00000299155
MGVLGRVLLWLQLCALTQAVSKLWVPNTDFDVAANWSQNRTPCAGGAVEFPADKMVSVLVQEGHAVSDMLLPLDGELVLASGAGFGVSDVGSHLDCGAGEPAVFRDSDRFSWHDPHLWRSGDEAPGLFFVDAERVPCRHDDVFFPPSASFRVGLGPGASPVRVRSISALGRTFTRDEDLAVFLASRAGRLRFHGPGALSVGPEDCADPSGCVCGNAEAQPWICAALLQPLGGRCPQAACHSALRPQGQCCDLCGAVVLLTHGPAFDLERYRARILDTFLGLPQYHGLQVAVSKVPRSSRLREADTEIQVVLVENGPETGGAGRLARALLADVAENGEALGVLEATMRESGAHVWGSSAAGLAGGVAAAVLLALLVLLVAPPLLRRAGRLRWRRHEAAAPAGAPLGFRNPVFDVTASEELPLPRRLSLVPKAAADSTSHSYFVNPLFAGAEAEA

SEQ ID NO: 4470 - protein, 131 aa, Homo sapiens
  Payload ID: 998;
  Gene Symbol: AMN;
  Gene Name: amnion associated transmembrane prt;
  ENSP ID: ENSP00000452831
  MOD_RES (1)..(1): Any amino acid
XAPGLFFVDAERVPCRHDDVFFPPSASFRVGLGPGASPVRVRSEALGVLEATMRESGAHVWGSSAAGLAGGVAAAVLLALLVLLVAPPLLRRAGRLRWRRHEAAAPAGAPLGFRNPVFDVTASEELPLPRR

SEQ ID NO: 4471 - protein, 107 aa, Homo sapiens
  Payload ID: 998;
  Gene Symbol: AMN;
  Gene Name: amnion associated transmembrane prt;
  ENSP ID: ENSP00000453786
  MOD_RES (1)..(1): Any amino acid
XLWRSGDEAPGLFFVDAERVPCRHDDVFFPPSASFRVGLGPGASPTFTRDEDLAVFLASRAGRLRFHGPGALSVGPEDCADPSGCVCGNAEAQPWICAALLQPLGGR

SEQ ID NO: 4472 - protein, 653 aa, Homo sapiens
  Payload ID: 999;
  Gene Symbol: AMPH;
  Gene Name: amphiphysin;
  Uniprot ID:  P49418;
  ENSP ID: ENSP00000317441
MADIKTGIFAKNVQKRLNRAQEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTSTDLVQPASGGSFNGFTQPQDTSLFTMQTDQSMICNLIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 4473 - protein, 695 aa, Homo sapiens
  Payload ID: 999;
  Gene Symbol: AMPH;
  Gene Name: amphiphysin;
  Uniprot ID:  P49418;
  ENSP ID: ENSP00000348602
MADIKTGIFAKNVQKRLNRAQEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTSTDLVQPASGGSFNGFTQPQDTSLFTMQTDQSMICNLAESEQAPPTEPKAEEPLAAVTPAVGLDLGMDTRAEEPVEEAVIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 4474 - protein, 112 aa, Homo sapiens
  Payload ID: 999;
  Gene Symbol: AMPH;
  Gene Name: amphiphysin;
  ENSP ID: ENSP00000400404
  MOD_RES (1)..(1): Any amino acid
XGGNEQLPPKPAPEAGVAIAACVEMEQLYDPLDSDMPAMDTAGLFKESHEDMKKSDEEEEKQKMEDSLWAGVEACQKASGGSFNGFTQPQDTSLFTMQTDQSMICNLEITVN

SEQ ID NO: 4475 - protein, 578 aa, Homo sapiens
  Payload ID: 999;
  Gene Symbol: AMPH;
  Gene Name: amphiphysin;
  ENSP ID: ENSP00000415085
  MOD_RES (1)..(1): Any amino acid
XDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTSTDLVQPTDSSESLSLCNLIMEETPDSGLAEEIQRSQNDIGAFTWGPDASTDRVSQEVTSGGFGEDSACPSETEQDIRLSTSLLSSADWPTVAEESEHAPGPAFPGGNEQLPPKPAPEAGVAIAACVEMEQLYDPLDSDMPAMDTAGLFKESHEDMKKSDEEEEKQKMEDSLWAGVEACQKASGGSFNGFTQPQDTSLFTMQTDQSMICNLIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 4476 - protein, 252 aa, Homo sapiens
  Payload ID: 1000;
  Gene Symbol: AREG;
  Gene Name: amphiregulin;
  Uniprot ID:  P15514;
  ENSP ID: ENSP00000379097
MRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSKIALAAIAAFMSAVILTAVAVITVQLRRQYVRKYEGEAEERKKLRQENGNVHAIA

SEQ ID NO: 4477 - protein, 274 aa, Homo sapiens
  Payload ID: 1000;
  Gene Symbol: AREG;
  Gene Name: amphiregulin;
  ENSP ID: ENSP00000421414
MRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSKIALAAIAAFMSAVILTAVAVITVQISHWSHCQVIAINDESVLFPVDHKTMDPFCYDGFKLSIVTFYAISVYKGARR

SEQ ID NO: 4478 - protein, 511 aa, Homo sapiens
  Payload ID: 1001;
  Gene Symbol: AMY1A;
  Gene Name: amylase, alpha 1A (salivary);
  Uniprot ID:  P04745;
  ENSP ID: ENSP00000359100
MKLFWLLFTIGFCWAQYSSNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLSGLLDLALGKDYVRSKIAEYMNHLIDIGVAGFRIDASKHMWPGDIKAILDKLHNLNSNWFPEGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRYFENGKDVNDWVGPPNDNGVTKEVTINPDTTCGNDWVCEHRWRQIRNMVNFRNVVDGQPFTNWYDNGSNQVAFGRGNRGFIVFNNDDWTFSLTLQTGLPAGTYCDVISGDKINGNCTGIKIYVSDDGKAHFSISNSAEDPFIAIHAESKL

SEQ ID NO: 4479 - protein, 226 aa, Homo sapiens
  Payload ID: 1001;
  Gene Symbol: AMY1A;
  Gene Name: amylase, alpha 1A (salivary);
  ENSP ID: ENSP00000399836
MKLFWLLFTIGFCWAQYSSNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLSGLLDLALGKDYVRSKIAEYMNHLIDIGVAGFRIDASKHMWPGDIKAIL

SEQ ID NO: 4480 - protein, 105 aa, Homo sapiens
  Payload ID: 1001;
  Gene Symbol: AMY1A;
  Gene Name: amylase, alpha 1A (salivary);
  ENSP ID: ENSP00000408386
MKLFWLLFTIGFCWAQYSSNTQQGRTSIVHLFEWRWVDIALECERYLAPKGFGGVQVSPPNENVAIHNPFRPWWERYQPVSYKLCTRSGNEDEFRNMVTRCNNVG

SEQ ID NO: 4481 - protein, 511 aa, Homo sapiens; identical to SEQ ID NO: 4478
  Payload ID: 1002;
  Gene Symbol: AMY1B;
  Gene Name: amylase, alpha 1B (salivary);
  Uniprot ID:  P04745;
  ENSP ID: ENSP00000330484

SEQ ID NO: 4482 - protein, 511 aa, Homo sapiens; identical to SEQ ID NO: 4478
  Payload ID: 1002;
  Gene Symbol: AMY1B;
  Gene Name: amylase, alpha 1B (salivary);
  Uniprot ID:  P04745;
  ENSP ID: ENSP00000359097

SEQ ID NO: 4483 - protein, 226 aa, Homo sapiens; identical to SEQ ID NO: 4479
  Payload ID: 1002;
  Gene Symbol: AMY1B;
  Gene Name: amylase, alpha 1B (salivary);
  ENSP ID: ENSP00000390219

SEQ ID NO: 4484 - protein, 105 aa, Homo sapiens; identical to SEQ ID NO: 4480
  Payload ID: 1002;
  Gene Symbol: AMY1B;
  Gene Name: amylase, alpha 1B (salivary);
  ENSP ID: ENSP00000393584

SEQ ID NO: 4485 - protein, 511 aa, Homo sapiens; identical to SEQ ID NO: 4478
  Payload ID: 1003;
  Gene Symbol: AMY1C;
  Gene Name: amylase, alpha 1C (salivary);
  Uniprot ID:  P04745;
  ENSP ID: ENSP00000359096

SEQ ID NO: 4486 - protein, 209 aa, Homo sapiens
  Payload ID: 1004;
  Gene Symbol: AMY2A;
  Gene Name: amylase, alpha 2A (pancreatic);
  ENSP ID: ENSP00000390832
  MOD_RES (1)..(1): Any amino acid
XFFLLLFTIGFCWAQYSPNTQQGRTSIVHLFEWRWVDIALECERYLAPKGFGGVQVSPPNENVAIYNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVIDLGGEPIKSSDYFGNGRVTEFKYGAKLGTVIRKWNGE

SEQ ID NO: 4487 - protein, 511 aa, Homo sapiens
  Payload ID: 1004;
  Gene Symbol: AMY2A;
  Gene Name: amylase, alpha 2A (pancreatic);
  Uniprot ID:  P04746;
  ENSP ID: ENSP00000397582
MKFFLLLFTIGFCWAQYSPNTQQGRTSIVHLFEWRWVDIALECERYLAPKGFGGVQVSPPNENVAIYNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLTGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFVPSDRALVFVDNHDNQRGHGAGGASILTFWDARLYKMAVGFMLAHPYGFTRVMSSYRWPRQFQNGNDVNDWVGPPNNNGVIKEVTINPDTTCGNDWVCEHRWRQIRNMVIFRNVVDGQPFTNWYDNGSNQVAFGRGNRGFIVFNNDDWSFSLTLQTGLPAGTYCDVISGDKINGNCTGIKIYVSDDGKAHFSISNSAEDPFIAIHAESKL

SEQ ID NO: 4488 - protein, 511 aa, Homo sapiens; identical to SEQ ID NO: 4487
  Payload ID: 1004;
  Gene Symbol: AMY2A;
  Gene Name: amylase, alpha 2A (pancreatic);
  Uniprot ID:  P04746;
  ENSP ID: ENSP00000481450

SEQ ID NO: 4489 - protein, 511 aa, Homo sapiens
  Payload ID: 1005;
  Gene Symbol: AMY2B;
  Gene Name: amylase, alpha 2B (pancreatic);
  Uniprot ID:  P19961;
  ENSP ID: ENSP00000354610
MKFFLLLFTIGFCWAQYSPNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMSGNAVSAGTSSTCGSYFNPGSRDFPAVPYSGWDFNDGKCKTGSGDIENYNDATQVRDCRLVGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRQFQNGNDVNDWVGPPNNNGVIKEVTINPDTTCGNDWVCEHRWRQIRNMVNFRNVVDGQPFTNWYDNGSNQVAFGRGNRGFIVFNNDDWTFSLTLQTGLPAGTYCDVISGDKINGNCTGIKIYVSDDGKAHFSISNSAEDPFIAIHAESKL

SEQ ID NO: 4490 - protein, 96 aa, Homo sapiens
  Payload ID: 1005;
  Gene Symbol: AMY2B;
  Gene Name: amylase, alpha 2B (pancreatic);
  ENSP ID: ENSP00000391423
MKFFLLLFTIGFCWAQYSPNTQQGRTSIVHLFEWRWVDIALECERYLAPKGFGGVQVSPPNENVAIHNPFRPWWERYQPVSYKLCTRSGNEDEFRN

SEQ ID NO: 4491 - protein, 86 aa, Homo sapiens
  Payload ID: 1005;
  Gene Symbol: AMY2B;
  Gene Name: amylase, alpha 2B (pancreatic);
  ENSP ID: ENSP00000401627
MKFFLLLFTIGFCWAQYSPNTQQGRTSIVHLFEWRWVDIALECERYLAPKGFGGVQVSPPNENVAIHNPFRPWWERYQPVSYKLCT

SEQ ID NO: 4492 - protein, 370 aa, Homo sapiens
  Payload ID: 1005;
  Gene Symbol: AMY2B;
  Gene Name: amylase, alpha 2B (pancreatic);
  Uniprot ID:  P19961;
  ENSP ID: ENSP00000433347
MKFFLLLFTIGFCWAQYSPNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMSGNAVSAGTSSTCGSYFNPGSRDFPAVPYSGWDFNDGKCKTGSGDIENYNDATQVRDCRLVGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRQFQNGNEHG

SEQ ID NO: 4493 - protein, 511 aa, Homo sapiens; identical to SEQ ID NO: 4489
  Payload ID: 1005;
  Gene Symbol: AMY2B;
  Gene Name: amylase, alpha 2B (pancreatic);
  Uniprot ID:  P19961;
  ENSP ID: ENSP00000481588

SEQ ID NO: 4494 - protein, 1532 aa, Homo sapiens
  Payload ID: 1006;
  Gene Symbol: AGL;
  Gene Name: amylo-alpha-1, 6-glucosidase, 4-alpha-glucanotransferase;
  Uniprot ID:  P35573;
  ENSP ID: ENSP00000294724
MGHSKQIRILLLNEMEKLEKTLFRLEQGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 4495 - protein, 1515 aa, Homo sapiens
  Payload ID: 1006;
  Gene Symbol: AGL;
  Gene Name: amylo-alpha-1, 6-glucosidase, 4-alpha-glucanotransferase;
  Uniprot ID:  P35573;
  ENSP ID: ENSP00000354635
MSLLTCAFYLGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 4496 - protein, 1516 aa, Homo sapiens
  Payload ID: 1006;
  Gene Symbol: AGL;
  Gene Name: amylo-alpha-1, 6-glucosidase, 4-alpha-glucanotransferase;
  Uniprot ID:  P35573;
  ENSP ID: ENSP00000354971
MAPILSINLFIGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 4497 - protein, 1532 aa, Homo sapiens; identical to SEQ ID NO: 4494
  Payload ID: 1006;
  Gene Symbol: AGL;
  Gene Name: amylo-alpha-1, 6-glucosidase, 4-alpha-glucanotransferase;
  Uniprot ID:  P35573;
  ENSP ID: ENSP00000355106

SEQ ID NO: 4498 - protein, 1516 aa, Homo sapiens; identical to SEQ ID NO: 4496
  Payload ID: 1006;
  Gene Symbol: AGL;
  Gene Name: amylo-alpha-1, 6-glucosidase, 4-alpha-glucanotransferase;
  Uniprot ID:  P35573;
  ENSP ID: ENSP00000359180

SEQ ID NO: 4499 - protein, 1532 aa, Homo sapiens; identical to SEQ ID NO: 4494
  Payload ID: 1006;
  Gene Symbol: AGL;
  Gene Name: amylo-alpha-1, 6-glucosidase, 4-alpha-glucanotransferase;
  Uniprot ID:  P35573;
  ENSP ID: ENSP00000359182

SEQ ID NO: 4500 - protein, 1532 aa, Homo sapiens; identical to SEQ ID NO: 4494
  Payload ID: 1006;
  Gene Symbol: AGL;
  Gene Name: amylo-alpha-1, 6-glucosidase, 4-alpha-glucanotransferase;
  Uniprot ID:  P35573;
  ENSP ID: ENSP00000359184

SEQ ID NO: 4501 - protein, 770 aa, Homo sapiens
  Payload ID: 1007;
  Gene Symbol: APP;
  Gene Name: amyloid beta (A4) precursor prt;
  Uniprot ID:  P05067;
  ENSP ID: ENSP00000284981
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4502 - protein, 695 aa, Homo sapiens
  Payload ID: 1007;
  Gene Symbol: APP;
  Gene Name: amyloid beta (A4) precursor prt;
  Uniprot ID:  P05067;
  ENSP ID: ENSP00000345463
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4503 - protein, 639 aa, Homo sapiens
  Payload ID: 1007;
  Gene Symbol: APP;
  Gene Name: amyloid beta (A4) precursor prt;
  Uniprot ID:  P05067;
  ENSP ID: ENSP00000346129
MLPGLALLLLAAWTARALEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4504 - protein, 751 aa, Homo sapiens
  Payload ID: 1007;
  Gene Symbol: APP;
  Gene Name: amyloid beta (A4) precursor prt;
  Uniprot ID:  P05067;
  ENSP ID: ENSP00000350578
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4505 - protein, 752 aa, Homo sapiens
  Payload ID: 1007;
  Gene Symbol: APP;
  Gene Name: amyloid beta (A4) precursor prt;
  Uniprot ID:  P05067;
  ENSP ID: ENSP00000351796
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4506 - protein, 660 aa, Homo sapiens
  Payload ID: 1007;
  Gene Symbol: APP;
  Gene Name: amyloid beta (A4) precursor prt;
  ENSP ID: ENSP00000352760
MFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4507 - protein, 746 aa, Homo sapiens
  Payload ID: 1007;
  Gene Symbol: APP;
  Gene Name: amyloid beta (A4) precursor prt;
  Uniprot ID:  P05067;
  ENSP ID: ENSP00000387483
MDQLEDLLVLFINYVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4508 - protein, 485 aa, Homo sapiens
  Payload ID: 1007;
  Gene Symbol: APP;
  Gene Name: amyloid beta (A4) precursor prt;
  ENSP ID: ENSP00000396923
  MOD_RES (1)..(1): Any amino acid
XLQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVGAVAHACNSSILGGQGGQMT

SEQ ID NO: 4509 - protein, 714 aa, Homo sapiens
  Payload ID: 1007;
  Gene Symbol: APP;
  Gene Name: amyloid beta (A4) precursor prt;
  ENSP ID: ENSP00000398879
MLPGLALLLLAAWTARALEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4510 - protein, 181 aa, Homo sapiens
  Payload ID: 1007;
  Gene Symbol: APP;
  Gene Name: amyloid beta (A4) precursor prt;
  ENSP ID: ENSP00000406539
  MOD_RES (1)..(1): Any amino acid
XGGADTDYADGSEDKVVEVAEEEEVAEVEEEEADDDEDDEDGDEVEEEAEEPYEEATERTTSIATTTTTTTESVEEVVRVSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEA

SEQ ID NO: 4511 - protein, 837 aa, Homo sapiens
  Payload ID: 1008;
  Gene Symbol: APBA1;
  Gene Name: amyloid beta (A4) precursor prt-binding, family A, member 1;
  Uniprot ID:  Q02410;
  ENSP ID: ENSP00000265381
MNHLEGSAEVEVTDEAAGGEVNESVEADLEHPEVEEEQQQPPQQQHYVGRHQRGRALEDLRAQLGQEEEERGECLARSASTESGFHNHTDTAEGDVIAAARDGYDAERAQDPEDESAYAVQYRPEAEEYTEQAEAEHAEATHRRALPNHLHFHSLEHEEAMNAAYSGYVYTHRLFHRGEDEPYSEPYADYGGLQEHVYEEIGDAPELDARDGLRLYEQERDEAAAYRQEALGARLHHYDERSDGESDSPEKEAEFAPYPRMDSYEQEEDIDQIVAEVKQSMSSQSLDKAAEDMPEAEQDLERPPTPAGGRPDSPGLQAPAGQQRAVGPAGGGEAGQRYSKEKRDAISLAIKDIKEAIEEVKTRTIRSPYTPDEPKEPIWVMRQDISPTRDCDDQRPMDGDSPSPGSSSPLGAESSSTSLHPSDPVEASTNKESRKSLASFPTYVEVPGPCDPEDLIDGIIFAANYLGSTQLLSDKTPSKNVRMMQAQEAVSRIKMAQKLAKSRKKAPEGESQPMTEVDLFISTQRIKVLNADTQETMMDHPLRTISYIADIGNIVVLMARRRMPRSNSQENVEASHPSQDGKRQYKMICHVFESEDAQLIAQSIGQAFSVAYQEFLRANGINPEDLSQKEYSDLLNTQDMYNDDLIHFSKSENCKDVFIEKQKGEILGVVIVESGWGSILPTVIIANMMHGGPAEKSGKLNIGDQIMSINGTSLVGLPLSTCQSIIKGLKNQSRVKLNIVRCPPVTTVLIRRPDLRYQLGFSVQNGIICSLMRGGIAERGGVRVGHRIIEINGQSVVATPHEKIVHILSNAVGEIHMKTMPAAMYRLLTAQEQPVYI

SEQ ID NO: 4512 - protein, 437 aa, Homo sapiens
  Payload ID: 1008;
  Gene Symbol: APBA1;
  Gene Name: amyloid beta (A4) precursor prt-binding, family A, member 1;
  ENSP ID: ENSP00000479031
SPSPGSSSPLGAESSSTSLHPSDPVEASTNKESRKSLASFPTYVEVPGPCDPEDLIDGIIFAANYLGSTQLLSDKTPSKNVRMMQAQEAVSRIKMAQKLAKSRKKAPEGESQPMTEVDLFISTQRIKVLNADTQETMMDHPLRTISYIADIGNIVVLMARRRMPRSNSQENVEASHPSQDGKRQYKMICHVFESEDAQLIAQSIGQAFSVAYQEFLRANGINPEDLSQKEYSDLLNTQDMYNDDLIHFSKSENCKDVFIEKQKGEILGVVIVESGWGSILPTVIIANMMHGGPAEKSGKLNIGDQIMSINGTSLVGLPLSTCQSIIKGLKNQSRVKLNIVRCPPVTTVLIRRPDLRYQLGFSVQNGIICSLMRGGIAERGGVRVGHRIIEINGQSVVATPHEKIVHILSNAVGEIHMKTMPAAMYRLLTAQEQPVYI

SEQ ID NO: 4513 - protein, 122 aa, Homo sapiens
  Payload ID: 1008;
  Gene Symbol: APBA1;
  Gene Name: amyloid beta (A4) precursor prt-binding, family A, member 1;
  ENSP ID: ENSP00000486435
EDLIDGIIFAANYLGSTQLLSDKTPSKNVRMMQAQEAVSRIKAPEGESQPMTEVDLFISTQRIKVLNADTQETMMDHPLRTISYIADIGNIVVLMARRRMPRSNSQENVEASHPSQDGKRQY

SEQ ID NO: 4514 - protein, 122 aa, Homo sapiens; identical to SEQ ID NO: 4513
  Payload ID: 1008;
  Gene Symbol: APBA1;
  Gene Name: amyloid beta (A4) precursor prt-binding, family A, member 1;
  ENSP ID: ENSP00000486873

SEQ ID NO: 4515 - protein, 737 aa, Homo sapiens
  Payload ID: 1009;
  Gene Symbol: APBA2;
  Gene Name: amyloid beta (A4) precursor prt-binding, family A, member 2;
  Uniprot ID:  Q99767;
  ENSP ID: ENSP00000409312
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVEACPPIKASCSPSRHEARPKSLNLLPEAKHPGDPQRGFKPKTRTPEERLKWPHEQVCNGLEQPRKQQRSDLNGPVDNNNIPETKKVASFPSFVAVPGPCEPEDLIDGIIFAANYLGSTQLLSERNPSKNIRMMQAQEAVSRVKNSEGDAQTLTEVDLFISTQRIKVLNADTQETMMDHALRTISYIADIGNIVVLMARRRMPRSASQDCIETTPGAQEGKKQYKMICHVFESEDAQLIAQSIGQAFSVAYQEFLRANGINPEDLSQKEYSDIINTQEMYNDDLIHFSNSENCKELQLEKHKGEILGVVVVESGWGSILPTVILANMMNGGPAARSGKLSIGDQIMSINGTSLVGLPLATCQGIIKGLKNQTQVKLNIVSCPPVTTVLIKRPDLKYQLGFSVQNGIICSLMRGGIAERGGVRVGHRIIEINGQSVVATAHEKIVQALSNSVGEIHMKTMPAAMFRLLTGQETPLYI

SEQ ID NO: 4516 - protein, 4 aa, Homo sapiens
  Payload ID: 1009;
  Gene Symbol: APBA2;
  Gene Name: amyloid beta (A4) precursor prt-binding, family A, member 2;
  ENSP ID: ENSP00000452699
MAHR

SEQ ID NO: 4517 - protein, 737 aa, Homo sapiens; identical to SEQ ID NO: 4515
  Payload ID: 1009;
  Gene Symbol: APBA2;
  Gene Name: amyloid beta (A4) precursor prt-binding, family A, member 2;
  Uniprot ID:  Q99767;
  ENSP ID: ENSP00000452722

SEQ ID NO: 4518 - protein, 112 aa, Homo sapiens
  Payload ID: 1009;
  Gene Symbol: APBA2;
  Gene Name: amyloid beta (A4) precursor prt-binding, family A, member 2;
  ENSP ID: ENSP00000453034
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLE

SEQ ID NO: 4519 - protein, 749 aa, Homo sapiens
  Payload ID: 1009;
  Gene Symbol: APBA2;
  Gene Name: amyloid beta (A4) precursor prt-binding, family A, member 2;
  Uniprot ID:  Q99767;
  ENSP ID: ENSP00000453144
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVEACPPIKASCSPSRHEARPKSLNLLPEAKHPGDPQRGFKPKTRTPEERLKWPHEQVCNGLEQPRKQQRSDLNGPVDNNNIPETKKVASFPSFVAVPGPCEPEDLIDGIIFAANYLGSTQLLSERNPSKNIRMMQAQEAVSRVKRMQKAAKIKKKANSEGDAQTLTEVDLFISTQRIKVLNADTQETMMDHALRTISYIADIGNIVVLMARRRMPRSASQDCIETTPGAQEGKKQYKMICHVFESEDAQLIAQSIGQAFSVAYQEFLRANGINPEDLSQKEYSDIINTQEMYNDDLIHFSNSENCKELQLEKHKGEILGVVVVESGWGSILPTVILANMMNGGPAARSGKLSIGDQIMSINGTSLVGLPLATCQGIIKGLKNQTQVKLNIVSCPPVTTVLIKRPDLKYQLGFSVQNGIICSLMRGGIAERGGVRVGHRIIEINGQSVVATAHEKIVQALSNSVGEIHMKTMPAAMFRLLTGQETPLYI

SEQ ID NO: 4520 - protein, 749 aa, Homo sapiens; identical to SEQ ID NO: 4519
  Payload ID: 1009;
  Gene Symbol: APBA2;
  Gene Name: amyloid beta (A4) precursor prt-binding, family A, member 2;
  Uniprot ID:  Q99767;
  ENSP ID: ENSP00000453293

SEQ ID NO: 4521 - protein, 263 aa, Homo sapiens
  Payload ID: 1009;
  Gene Symbol: APBA2;
  Gene Name: amyloid beta (A4) precursor prt-binding, family A, member 2;
  ENSP ID: ENSP00000453715
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVE

SEQ ID NO: 4522 - protein, 27 aa, Homo sapiens
  Payload ID: 1009;
  Gene Symbol: APBA2;
  Gene Name: amyloid beta (A4) precursor prt-binding, family A, member 2;
  ENSP ID: ENSP00000453981
MAHRKLESVGSGMLDHRVRPGPVPHSQ

SEQ ID NO: 4523 - protein, 70 aa, Homo sapiens
  Payload ID: 1009;
  Gene Symbol: APBA2;
  Gene Name: amyloid beta (A4) precursor prt-binding, family A, member 2;
  ENSP ID: ENSP00000454001
MAHRKLESVGSGMLDHRVRPGPVPHSQEPESEDMELPLEGYVPEGLELAALRPESPAPEEQECHNHSPDG

SEQ ID NO: 4524 - protein, 749 aa, Homo sapiens; identical to SEQ ID NO: 4519
  Payload ID: 1009;
  Gene Symbol: APBA2;
  Gene Name: amyloid beta (A4) precursor prt-binding, family A, member 2;
  Uniprot ID:  Q99767;
  ENSP ID: ENSP00000454171

SEQ ID NO: 4525 - protein, 749 aa, Homo sapiens; identical to SEQ ID NO: 4519
  Payload ID: 1009;
  Gene Symbol: APBA2;
  Gene Name: amyloid beta (A4) precursor prt-binding, family A, member 2;
  Uniprot ID:  Q99767;
  ENSP ID: ENSP00000480384

SEQ ID NO: 4526 - protein, 737 aa, Homo sapiens; identical to SEQ ID NO: 4515
  Payload ID: 1009;
  Gene Symbol: APBA2;
  Gene Name: amyloid beta (A4) precursor prt-binding, family A, member 2;
  Uniprot ID:  Q99767;
  ENSP ID: ENSP00000483174

SEQ ID NO: 4527 - protein, 263 aa, Homo sapiens; identical to SEQ ID NO: 4521
  Payload ID: 1009;
  Gene Symbol: APBA2;
  Gene Name: amyloid beta (A4) precursor prt-binding, family A, member 2;
  ENSP ID: ENSP00000487880

SEQ ID NO: 4528 - protein, 27 aa, Homo sapiens
  Payload ID: 1009;
  Gene Symbol: APBA2;
  Gene Name: amyloid beta (A4) precursor prt-binding, family A, member 2;
  ENSP ID: ENSP00000488031
MAHRKLESVGSGMLDHRVRPGPVPHSQ

SEQ ID NO: 4529 - protein, 749 aa, Homo sapiens; identical to SEQ ID NO: 4519
  Payload ID: 1009;
  Gene Symbol: APBA2;
  Gene Name: amyloid beta (A4) precursor prt-binding, family A, member 2;
  Uniprot ID:  Q99767;
  ENSP ID: ENSP00000488107

SEQ ID NO: 4530 - protein, 4 aa, Homo sapiens
  Payload ID: 1009;
  Gene Symbol: APBA2;
  Gene Name: amyloid beta (A4) precursor prt-binding, family A, member 2;
  ENSP ID: ENSP00000488322
MAHR

SEQ ID NO: 4531 - protein, 112 aa, Homo sapiens; identical to SEQ ID NO: 4518
  Payload ID: 1009;
  Gene Symbol: APBA2;
  Gene Name: amyloid beta (A4) precursor prt-binding, family A, member 2;
  ENSP ID: ENSP00000488620

SEQ ID NO: 4532 - protein, 70 aa, Homo sapiens; identical to SEQ ID NO: 4523
  Payload ID: 1009;
  Gene Symbol: APBA2;
  Gene Name: amyloid beta (A4) precursor prt-binding, family A, member 2;
  ENSP ID: ENSP00000488632

SEQ ID NO: 4533 - protein, 575 aa, Homo sapiens
  Payload ID: 1010;
  Gene Symbol: APBA3;
  Gene Name: amyloid beta (A4) precursor prt-binding, family A, member 3;
  Uniprot ID:  O96018;
  ENSP ID: ENSP00000315136
MDFPTISRSPSGPPAMDLEGPRDILVPSEDLTPDSQWDPMPGGPGSLSRMELDESSLQELVQQFEALPGDLVGPSPGGAPCPLHIATGHGLASQEIADAHGLLSAEAGRDDLLGLLHCEECPPSQTGPEEPLEPAPRLLQPPEDPDEDSDSPEWVEGASAEQEGSRSSSSSPEPWLETVPLVTPEEPPAGAQSPETLASYPAPQEVPGPCDHEDLLDGVIFGARYLGSTQLVSERNPPTSTRMAQAREAMDRVKAPDGETQPMTEVDLFVSTKRIKVLTADSQEAMMDHALHTISYTADIGCVLVLMARRRLARRPAPQDHGRRLYKMLCHVFYAEDAQLIAQAIGQAFAAAYSQFLRESGIDPSQVGVHPSPGACHLHNGDLDHFSNSDNCREVHLEKRRGEGLGVALVESGWGSLLPTAVIANLLHGGPAERSGALSIGDRLTAINGTSLVGLPLAACQAAVRETKSQTSVTLSIVHCPPVTTAIIHRPHAREQLGFCVEDGIICSLLRGGIAERGGIRVGHRIIEINGQSVVATPHARIIELLTEAYGEVHIKTMPAATYRLLTGQEQPVYL

SEQ ID NO: 4534 - protein, 708 aa, Homo sapiens
  Payload ID: 1011;
  Gene Symbol: APBB1;
  Gene Name: amyloid beta (A4) precursor prt-binding, family B, member 1 (Fe65);
  Uniprot ID:  O00213;
  ENSP ID: ENSP00000299402
MSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 4535 - protein, 708 aa, Homo sapiens; identical to SEQ ID NO: 4534
  Payload ID: 1011;
  Gene Symbol: APBB1;
  Gene Name: amyloid beta (A4) precursor prt-binding, family B, member 1 (Fe65);
  Uniprot ID:  O00213;
  ENSP ID: ENSP00000311912

SEQ ID NO: 4536 - protein, 710 aa, Homo sapiens [sequence omitted]

SEQ ID NO: 4537 - protein, 488 aa, Homo sapiens
  Payload ID: 1011;
  Gene Symbol: APBB1;
  Gene Name: amyloid beta (A4) precursor prt-binding, family B, member 1 (Fe65);
  Uniprot ID:  O00213;
  ENSP ID: ENSP00000433338
MSAMFSQDFFLAIILQDSSADSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 4538 - protein, 451 aa, Homo sapiens
  Payload ID: 1011;
  Gene Symbol: APBB1;
  Gene Name: amyloid beta (A4) precursor prt-binding, family B, member 1 (Fe65);
  Uniprot ID:  O00213;
  ENSP ID: ENSP00000476442
MRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 4539 - protein, 261 aa, Homo sapiens
  Payload ID: 1011;
  Gene Symbol: APBB1;
  Gene Name: amyloid beta (A4) precursor prt-binding, family B, member 1 (Fe65);
  ENSP ID: ENSP00000476536
MRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRDFAYVARDKLTQMLKCHVFRCEAPAKNIATSLHEICSKIMAERRNARCLVNGLSLDHSK

SEQ ID NO: 4540 - protein, 451 aa, Homo sapiens; identical to SEQ ID NO: 4538
  Payload ID: 1011;
  Gene Symbol: APBB1;
  Gene Name: amyloid beta (A4) precursor prt-binding, family B, member 1 (Fe65);
  Uniprot ID:  O00213;
  ENSP ID: ENSP00000476646

SEQ ID NO: 4541 - protein, 87 aa, Homo sapiens
  Payload ID: 1011;
  Gene Symbol: APBB1;
  Gene Name: amyloid beta (A4) precursor prt-binding, family B, member 1 (Fe65);
  ENSP ID: ENSP00000476647
MRVQDTSGTYYWHIPTGTTQWEPPGRASPSQGSSPQEESQLTWTGFAHGEGFEDGEFWKDEPSDEAPMELGLKEPEEGTLTFPAQSL

SEQ ID NO: 4542 - protein, 706 aa, Homo sapiens
  Payload ID: 1011;
  Gene Symbol: APBB1;
  Gene Name: amyloid beta (A4) precursor prt-binding, family B, member 1 (Fe65);
  ENSP ID: ENSP00000476776
MSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMVEQEELVQARPHPPGPSRGRRRKGLVQAWVPSPCSMGTSAVLISLIKSVCT

SEQ ID NO: 4543 - protein, 490 aa, Homo sapiens
  Payload ID: 1011;
  Gene Symbol: APBB1;
  Gene Name: amyloid beta (A4) precursor prt-binding, family B, member 1 (Fe65);
  Uniprot ID:  O00213;
  ENSP ID: ENSP00000476846
MSAMFSQDFFLAIILQDSSADSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 4544 - protein, 451 aa, Homo sapiens; identical to SEQ ID NO: 4538
  Payload ID: 1011;
  Gene Symbol: APBB1;
  Gene Name: amyloid beta (A4) precursor prt-binding, family B, member 1 (Fe65);
  Uniprot ID:  O00213;
  ENSP ID: ENSP00000476871

SEQ ID NO: 4545 - protein, 235 aa, Homo sapiens
  Payload ID: 1011;
  Gene Symbol: APBB1;
  Gene Name: amyloid beta (A4) precursor prt-binding, family B, member 1 (Fe65);
  ENSP ID: ENSP00000477022
MLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 4546 - protein, 475 aa, Homo sapiens
  Payload ID: 1011;
  Gene Symbol: APBB1;
  Gene Name: amyloid beta (A4) precursor prt-binding, family B, member 1 (Fe65);
  Uniprot ID:  O00213;
  ENSP ID: ENSP00000477069
MTQMRDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 4547 - protein, 710 aa, Homo sapiens
  Payload ID: 1011;
  Gene Symbol: APBB1;
  Gene Name: amyloid beta (A4) precursor prt-binding, family B, member 1 (Fe65);
  Uniprot ID:  O00213;
  ENSP ID: ENSP00000477213
MSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 4548 - protein, 475 aa, Homo sapiens [sequence omitted]

SEQ ID NO: 4549 - protein, 451 aa, Homo sapiens [sequence omitted]

SEQ ID NO: 4550 - protein, 451 aa, Homo sapiens [sequence omitted]

SEQ ID NO: 4551 - protein, 172 aa, Homo sapiens
  Payload ID: 1012;
  Gene Symbol: APBB1IP;
  Gene Name: amyloid beta (A4) precursor prt-binding, family B, member 1 interacting prt;
  Uniprot ID:  Q7Z5R6;
  ENSP ID: ENSP00000349237
MGESSEDIDQMFSTLLGEMDLLTQSLGVDTLPPPDPNPPRAEFNYSVGFKDLNESLNALEDQDLDALMADLVADISEAEQRTIQAQKESLQNQHHSASLQASIFSGAASLGYGTNVAATGISQYEDDLPPPPADPVLDLPLPPPPPEPLSQVSMWDQRWQDHQPLLPITDVP

SEQ ID NO: 4552 - protein, 666 aa, Homo sapiens
  Payload ID: 1012;
  Gene Symbol: APBB1IP;
  Gene Name: amyloid beta (A4) precursor prt-binding, family B, member 1 interacting prt;
  Uniprot ID:  Q7Z5R6;
  ENSP ID: ENSP00000365411
MGESSEDIDQMFSTLLGEMDLLTQSLGVDTLPPPDPNPPRAEFNYSVGFKDLNESLNALEDQDLDALMADLVADISEAEQRTIQAQKESLQNQHHSASLQASIFSGAASLGYGTNVAATGISQYEDDLPPPPADPVLDLPLPPPPPEPLSQEEEEAQAKADKIKLALEKLKEAKVKKLVVKVHMNDNSTKSLMVDERQLARDVLDNLFEKTHCDCNVDWCLYEIYPELQIERFFEDHENVVEVLSDWTRDTENKILFLEKEEKYAVFKNPQNFYLDNRGKKESKETNEKMNAKNKESLLEESFCGTSIIVPELEGALYLKEDGKKSWKRRYFLLRASGIYYVPKGKTKTSRDLACFIQFENVNIYYGTQHKMKYKAPTDYCFVLKHPQIQKESQYIKYLCCDDTRTLNQWVMGIRIAKYGKTLYDNYQRAVAKAGLASRWTNLGTVNAAAPAQPSTGPKTGTTQPNGQIPQATHSVSAVLQEAQRHAETSKDKKPALGNHHDPAVPRAPHAPKSSLPPPPPVRRSSDTSGSPATPLKAKGTGGGGLPAPPDDFLPPPPPPPPLDDPELPPPPPDFMEPPPDFVPPPPPSYAGIAGSELPPPPPPPPAPAPAPVPDSARPPPAVAKRPPVPPKRQENPGHPGGAGGGEQDFMSDLMKALQKKRGNVS

SEQ ID NO: 4553 - protein, 758 aa, Homo sapiens
  Payload ID: 1013;
  Gene Symbol: APBB2;
  Gene Name: amyloid beta (A4) precursor prt-binding, family B, member 2;
  Uniprot ID:  Q92870;
  ENSP ID: ENSP00000295974
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETDIWSDHSFQTDPDLPPGWKRVSDIAGTYYWHIPTGTTQWERPVSIPADLQGSRKGSLSSVTPSPTPENEKQPWSDFAVLNGGKINSDIWKDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 4554 - protein, 10 aa, Homo sapiens
  Payload ID: 1013;
  Gene Symbol: APBB2;
  Gene Name: amyloid beta (A4) precursor prt-binding, family B, member 2;
  ENSP ID: ENSP00000421205
MSEVLPADSG

SEQ ID NO: 4555 - protein, 87 aa, Homo sapiens
  Payload ID: 1013;
  Gene Symbol: APBB2;
  Gene Name: amyloid beta (A4) precursor prt-binding, family B, member 2;
  ENSP ID: ENSP00000421301
MAERKNAKALACSSLQERANVNLDVPLQVDFPTPKTELVQKFHVQYLGMLPVDKPVGMDILNSAIENLMTSSNKEDWLSVNMNVADA

SEQ ID NO: 4556 - protein, 737 aa, Homo sapiens
  Payload ID: 1013;
  Gene Symbol: APBB2;
  Gene Name: amyloid beta (A4) precursor prt-binding, family B, member 2;
  ENSP ID: ENSP00000421539
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETDIWSDHSFQTDPDLPPGWKRVSDIAGTYYWHIPTGTTQWERPVSIPADLQGSRKGSLSSVTPSPTPENEDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 4557 - protein, 95 aa, Homo sapiens
  Payload ID: 1013;
  Gene Symbol: APBB2;
  Gene Name: amyloid beta (A4) precursor prt-binding, family B, member 2;
  ENSP ID: ENSP00000421751
MAERKNAKALACSSLQERANVNLDVPLQVDFPTPKTELVQKFHVQYLGMLPVDKPVGMDILNSAIENLMTSSNKEDWLSVNMNVADATVTVISEK

SEQ ID NO: 4558 - protein, 27 aa, Homo sapiens
  Payload ID: 1013;
  Gene Symbol: APBB2;
  Gene Name: amyloid beta (A4) precursor prt-binding, family B, member 2;
  ENSP ID: ENSP00000422723
MSEVLPADSGVDTLAVFMASSGTTDVT

SEQ ID NO: 4559 - protein, 41 aa, Homo sapiens
  Payload ID: 1013;
  Gene Symbol: APBB2;
  Gene Name: amyloid beta (A4) precursor prt-binding, family B, member 2;
  ENSP ID: ENSP00000422948
  MOD_RES (1)..(1): Any amino acid
XDTPAKAIATSLHEICSKVRLWLNGRMPKRWPAAPYRKGPM

SEQ ID NO: 4560 - protein, 210 aa, Homo sapiens
  Payload ID: 1013;
  Gene Symbol: APBB2;
  Gene Name: amyloid beta (A4) precursor prt-binding, family B, member 2;
  Uniprot ID:  Q92870;
  ENSP ID: ENSP00000423765
MAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 4561 - protein, 140 aa, Homo sapiens
  Payload ID: 1013;
  Gene Symbol: APBB2;
  Gene Name: amyloid beta (A4) precursor prt-binding, family B, member 2;
  ENSP ID: ENSP00000424414
MASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRR

SEQ ID NO: 4562 - protein, 68 aa, Homo sapiens
  Payload ID: 1013;
  Gene Symbol: APBB2;
  Gene Name: amyloid beta (A4) precursor prt-binding, family B, member 2;
  ENSP ID: ENSP00000424579
MSEVLPADSGVDTLAVFMASSGTTDVTNRNSPATPPNTLNLRSSHNELLNAEIKHTETKNSTPPKCRK

SEQ ID NO: 4563 - protein, 142 aa, Homo sapiens
  Payload ID: 1013;
  Gene Symbol: APBB2;
  Gene Name: amyloid beta (A4) precursor prt-binding, family B, member 2;
  ENSP ID: ENSP00000425121
  MOD_RES (1)..(1): Any amino acid
XGEGKDMYLILENDMLSLVDPMDRSVLHSQPIVSIRVWGVGRDNGRERDFAYVARDKDTRILKCHVFRCDTPAKAIATSLHEICSKIMAERKNAKALACSSLQERANVNLDVPLQDFPTPKTELVQKFHVQYLGMLPVDKPV

SEQ ID NO: 4564 - protein, 26 aa, Homo sapiens
  Payload ID: 1013;
  Gene Symbol: APBB2;
  Gene Name: amyloid beta (A4) precursor prt-binding, family B, member 2;
  ENSP ID: ENSP00000425202
MASSGTTDVTNRNSPATPPNTLNLRS

SEQ ID NO: 4565 - protein, 210 aa, Homo sapiens; identical to SEQ ID NO: 4560
  Payload ID: 1013;
  Gene Symbol: APBB2;
  Gene Name: amyloid beta (A4) precursor prt-binding, family B, member 2;
  Uniprot ID:  Q92870;
  ENSP ID: ENSP00000425802

SEQ ID NO: 4566 - protein, 736 aa, Homo sapiens
  Payload ID: 1013;
  Gene Symbol: APBB2;
  Gene Name: amyloid beta (A4) precursor prt-binding, family B, member 2;
  Uniprot ID:  Q92870;
  ENSP ID: ENSP00000426018
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETDIWSDHSFQTDPDLPPGWKRVSDIAGTYYWHIPTGTTQWERPVSIPADLQGSRKGSLSSVTPSPTPENEDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 4567 - protein, 179 aa, Homo sapiens
  Payload ID: 1013;
  Gene Symbol: APBB2;
  Gene Name: amyloid beta (A4) precursor prt-binding, family B, member 2;
  ENSP ID: ENSP00000426429
VLHSQPIVSIRVWGVGRDNGRERDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKD

SEQ ID NO: 4568 - protein, 102 aa, Homo sapiens
  Payload ID: 1013;
  Gene Symbol: APBB2;
  Gene Name: amyloid beta (A4) precursor prt-binding, family B, member 2;
  ENSP ID: ENSP00000427107
MAERKNAKALACSSLQERANVNLDVPLQVDFPTPKTELVQKFHVQYLGMLPVDKPVGMDILNSAIENLMTSSNKEDWLSVNMNVADATVTVISEKNEEEVLV

SEQ ID NO: 4569 - protein, 759 aa, Homo sapiens
  Payload ID: 1013;
  Gene Symbol: APBB2;
  Gene Name: amyloid beta (A4) precursor prt-binding, family B, member 2;
  Uniprot ID:  Q92870;
  ENSP ID: ENSP00000427211
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETADIWSDHSFQTDPDLPPGWKRVSDIAGTYYWHIPTGTTQWERPVSIPADLQGSRKGSLSSVTPSPTPENEKQPWSDFAVLNGGKINSDIWKDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 4570 - protein, 728 aa, Homo sapiens
  Payload ID: 1013;
  Gene Symbol: APBB2;
  Gene Name: amyloid beta (A4) precursor prt-binding, family B, member 2;
  ENSP ID: ENSP00000427307
  MOD_RES (1)..(1): Any amino acid
XDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETADIWSDHSFQTDPDLPPGWKRVSDIAGTYYWHIPTGTTQWERPVSIPADLQGSRKGSLSSVTPSPTPENEDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 4571 - protein, 210 aa, Homo sapiens; identical to SEQ ID NO: 4560
  Payload ID: 1013;
  Gene Symbol: APBB2;
  Gene Name: amyloid beta (A4) precursor prt-binding, family B, member 2;
  Uniprot ID:  Q92870;
  ENSP ID: ENSP00000439357

SEQ ID NO: 4572 - protein, 493 aa, Homo sapiens
  Payload ID: 1014;
  Gene Symbol: APBB3;
  Gene Name: amyloid beta (A4) precursor prt-binding, family B, member 3;
  Uniprot ID:  O95704;
  ENSP ID: ENSP00000346378
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRDSPISAPARDFAFVASDKDSCMLKCHVFCCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 4573 - protein, 491 aa, Homo sapiens
  Payload ID: 1014;
  Gene Symbol: APBB3;
  Gene Name: amyloid beta (A4) precursor prt-binding, family B, member 3;
  Uniprot ID:  O95704;
  ENSP ID: ENSP00000349177
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRPISAPARDFAFVASDKDSCMLKCHVFCCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 4574 - protein, 486 aa, Homo sapiens
  Payload ID: 1014;
  Gene Symbol: APBB3;
  Gene Name: amyloid beta (A4) precursor prt-binding, family B, member 3;
  Uniprot ID:  O95704;
  ENSP ID: ENSP00000350171
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRDRDFAFVASDKDSCMLKCHVFCCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 4575 - protein, 339 aa, Homo sapiens
  Payload ID: 1014;
  Gene Symbol: APBB3;
  Gene Name: amyloid beta (A4) precursor prt-binding, family B, member 3;
  ENSP ID: ENSP00000351389
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRDRDFAFVASDKDSCMLKCHVFCCDVPAKAIASALHGLCAQILSERVEVSGDASCCSPDPISPEDLPRQVELLDAVSQAAQKYEALYMGTLPVTKAMGRGQYRGGAIVAVPCAPCDIYWCWPRPTHLWPHR

SEQ ID NO: 4576 - protein, 484 aa, Homo sapiens
  Payload ID: 1014;
  Gene Symbol: APBB3;
  Gene Name: amyloid beta (A4) precursor prt-binding, family B, member 3;
  Uniprot ID:  O95704;
  ENSP ID: ENSP00000402591
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRDFAFVASDKDSCMLKCHVFCCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 4577 - protein, 245 aa, Homo sapiens
  Payload ID: 1014;
  Gene Symbol: APBB3;
  Gene Name: amyloid beta (A4) precursor prt-binding, family B, member 3;
  Uniprot ID:  O95704;
  ENSP ID: ENSP00000422718
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRSSDVDPGLLPLPGPALVGEGGPSSAGTVWGESERLG

SEQ ID NO: 4578 - protein, 337 aa, Homo sapiens
  Payload ID: 1014;
  Gene Symbol: APBB3;
  Gene Name: amyloid beta (A4) precursor prt-binding, family B, member 3;
  ENSP ID: ENSP00000424317
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRDFAFVASDKDSCMLKCHVFCCDVPAKAIASALHGLCAQILSERVEVSGDASCCSPDPISPEDLPRQVELLDAVSQAAQKYEALYMGTLPVTKAMGRGQYRGGAIVAVPCAPCDIYWCWPRPTHLWPHR

SEQ ID NO: 4579 - protein, 214 aa, Homo sapiens
  Payload ID: 1014;
  Gene Symbol: APBB3;
  Gene Name: amyloid beta (A4) precursor prt-binding, family B, member 3;
  Uniprot ID:  O95704;
  ENSP ID: ENSP00000426107
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLAVIPTDADPQYLNPWTQIL

SEQ ID NO: 4580 - protein, 163 aa, Homo sapiens
  Payload ID: 1014;
  Gene Symbol: APBB3;
  Gene Name: amyloid beta (A4) precursor prt-binding, family B, member 3;
  ENSP ID: ENSP00000427272
MLGKDYMLAIILVNCDDDLWGDHSLEVEAGLPPGWRKIHDAAGTYYWHVPSGSTQWQRPTWELGDAEDPGTCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGR

SEQ ID NO: 4581 - protein, 651 aa, Homo sapiens
  Payload ID: 1015;
  Gene Symbol: APLP1;
  Gene Name: amyloid beta (A4) precursor-like prt 1;
  Uniprot ID:  P51693;
  ENSP ID: ENSP00000221891
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDADTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 4582 - protein, 611 aa, Homo sapiens
  Payload ID: 1015;
  Gene Symbol: APLP1;
  Gene Name: amyloid beta (A4) precursor-like prt 1;
  ENSP ID: ENSP00000441501
MLASLEKDKTAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 4583 - protein, 644 aa, Homo sapiens
  Payload ID: 1015;
  Gene Symbol: APLP1;
  Gene Name: amyloid beta (A4) precursor-like prt 1;
  ENSP ID: ENSP00000465694
MEAVCGAWGRGLVLGVSVLGSKEPGDPHANAPRALTVLSTSIQAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 4584 - protein, 173 aa, Homo sapiens
  Payload ID: 1015;
  Gene Symbol: APLP1;
  Gene Name: amyloid beta (A4) precursor-like prt 1;
  ENSP ID: ENSP00000466116
MYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETV

SEQ ID NO: 4585 - protein, 221 aa, Homo sapiens
  Payload ID: 1015;
  Gene Symbol: APLP1;
  Gene Name: amyloid beta (A4) precursor-like prt 1;
  ENSP ID: ENSP00000466576
  MOD_RES (1)..(1): Any amino acid
XEWAMADNQSKNLPKADRQALNEAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLL

SEQ ID NO: 4586 - protein, 118 aa, Homo sapiens
  Payload ID: 1015;
  Gene Symbol: APLP1;
  Gene Name: amyloid beta (A4) precursor-like prt 1;
  ENSP ID: ENSP00000466623
MGPASPAARGLSRRPGQPPLPLLLPLLLLLLRAQPAIGSLAGGSPGAAETHSALDAVSGTRSACWSTADRCTRSCRLHVWSRLRRPSPWSAGAGVPGAAAAPTPTTRLCPSAACLVNL

SEQ ID NO: 4587 - protein, 294 aa, Homo sapiens
  Payload ID: 1015;
  Gene Symbol: APLP1;
  Gene Name: amyloid beta (A4) precursor-like prt 1;
  ENSP ID: ENSP00000467854
MYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAA

SEQ ID NO: 4588 - protein, 289 aa, Homo sapiens
  Payload ID: 1015;
  Gene Symbol: APLP1;
  Gene Name: amyloid beta (A4) precursor-like prt 1;
  ENSP ID: ENSP00000474762
  MOD_RES (1)..(1): Any amino acid
XQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 4589 - protein, 763 aa, Homo sapiens
  Payload ID: 1016;
  Gene Symbol: APLP2;
  Gene Name: amyloid beta (A4) precursor-like prt 2;
  Uniprot ID:  Q06481;
  ENSP ID: ENSP00000263574
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 4590 - protein, 522 aa, Homo sapiens
  Payload ID: 1016;
  Gene Symbol: APLP2;
  Gene Name: amyloid beta (A4) precursor-like prt 2;
  Uniprot ID:  Q06481;
  ENSP ID: ENSP00000263575
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 4591 - protein, 761 aa, Homo sapiens
  Payload ID: 1016;
  Gene Symbol: APLP2;
  Gene Name: amyloid beta (A4) precursor-like prt 2;
  Uniprot ID:  Q06481;
  ENSP ID: ENSP00000278756
MLRAPGELPRQAARCSLCRLGPGRGRAFFKWRCLPASVDRGNPLWALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 4592 - protein, 751 aa, Homo sapiens
  Payload ID: 1016;
  Gene Symbol: APLP2;
  Gene Name: amyloid beta (A4) precursor-like prt 2;
  Uniprot ID:  Q06481;
  ENSP ID: ENSP00000345444
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 4593 - protein, 35 aa, Homo sapiens
  Payload ID: 1016;
  Gene Symbol: APLP2;
  Gene Name: amyloid beta (A4) precursor-like prt 2;
  ENSP ID: ENSP00000433582
MAATGTAAAAATGRLLLLLLVGLTAPALALAGYIE

SEQ ID NO: 4594 - protein, 158 aa, Homo sapiens
  Payload ID: 1016;
  Gene Symbol: APLP2;
  Gene Name: amyloid beta (A4) precursor-like prt 2;
  ENSP ID: ENSP00000434059
MAATGTAAAAATGRLLLLLLVGLTAPALALAGYIESSQICCSPRSFLISTLKCLIVDEINALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKC

SEQ ID NO: 4595 - protein, 158 aa, Homo sapiens
  Payload ID: 1016;
  Gene Symbol: APLP2;
  Gene Name: amyloid beta (A4) precursor-like prt 2;
  ENSP ID: ENSP00000434379
MAATGTAAAAATGRLLLLLLALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEV

SEQ ID NO: 4596 - protein, 39 aa, Homo sapiens
  Payload ID: 1016;
  Gene Symbol: APLP2;
  Gene Name: amyloid beta (A4) precursor-like prt 2;
  ENSP ID: ENSP00000434592
MAATGTAAAAATGRLLLLLLVGLTAPALALAGYIEWVNL

SEQ ID NO: 4597 - protein, 116 aa, Homo sapiens
  Payload ID: 1016;
  Gene Symbol: APLP2;
  Gene Name: amyloid beta (A4) precursor-like prt 2;
  ENSP ID: ENSP00000435470
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNSGWRCVRITSTGTR

SEQ ID NO: 4598 - protein, 695 aa, Homo sapiens
  Payload ID: 1016;
  Gene Symbol: APLP2;
  Gene Name: amyloid beta (A4) precursor-like prt 2;
  Uniprot ID:  Q06481;
  ENSP ID: ENSP00000435914
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 4599 - protein, 585 aa, Homo sapiens
  Payload ID: 1017;
  Gene Symbol: APPBP2;
  Gene Name: amyloid beta precursor prt (cytoplasmic tail) binding prt 2;
  Uniprot ID:  Q92624;
  ENSP ID: ENSP00000083182
MAAVELEWIPETLYNTAISAVVDNYIRSRRDIRSLPENIQFDVYYKLYQQGRLCQLGSEFCELEVFAKVLRALDKRHLLHHCFQALMDHGVKVASVLAYSFSRRCSYIAESDAAVKEKAIQVGFVLGGFLSDAGWYSDAEKVFLSCLQLCTLHDEMLHWFRAVECCVRLLHVRNGNCKYHLGEETFKLAQTYMDKLSKHGQQANKAALYGELCALLFAKSHYDEAYKWCIEAMKEITAGLPVKVVVDVLRQASKACVVKREFKKAEQLIKHAVYLARDHFGSKHPKYSDTLLDYGFYLLNVDNICQSVAIYQAALDIRQSVFGGKNIHVATAHEDLAYSSYVHQYSSGKFDNALFHAERAIGIITHILPEDHLLLASSKRVKALILEEIAIDCHNKETEQRLLQEAHDLHLSSLQLAKKAFGEFNVQTAKHYGNLGRLYQSMRKFKEAEEMHIKAIQIKEQLLGQEDYEVALSVGHLASLYNYDMNQYENAEKLYLRSIAIGKKLFGEGYSGLEYDYRGLIKLYNSIGNYEKVFEYHNVLSNWNRLRDRQYSVTDALEDVSTSPQSTEEVVQSFLISQNVEGPSC

SEQ ID NO: 4600 - protein, 123 aa, Homo sapiens
  Payload ID: 1017;
  Gene Symbol: APPBP2;
  Gene Name: amyloid beta precursor prt (cytoplasmic tail) binding prt 2;
  ENSP ID: ENSP00000464962
MAAVELEWIPETLYNTAISAVVDNYIRSRRDIRSLPENIQFDVYYKLYQQGRLCQLGSEFCELEVFAKVLRALDKRHLLHHCFQALMDHGVKVASVLAYSFSRRCSYIAESDAAVKEKAIQVG

SEQ ID NO: 4601 - protein, 95 aa, Homo sapiens
  Payload ID: 1017;
  Gene Symbol: APPBP2;
  Gene Name: amyloid beta precursor prt (cytoplasmic tail) binding prt 2;
  ENSP ID: ENSP00000466802
MAAVELEWIPETLYNTAISAVVDNYIRSRRDIRSLPENIQFDVYYKLYQQGRLCQLGSEFCELEVFAKVLRALDKRLSFTKSKSFDICFIIVFRL

SEQ ID NO: 4602 - protein, 61 aa, Homo sapiens
  Payload ID: 1017;
  Gene Symbol: APPBP2;
  Gene Name: amyloid beta precursor prt (cytoplasmic tail) binding prt 2;
  ENSP ID: ENSP00000467025
MAAVELEWIPETLYNTAISAVVDNYIRSRRDIRSLPENIQFDVYYKTFASSLFSGFDGSWC

SEQ ID NO: 4603 - protein, 223 aa, Homo sapiens
  Payload ID: 1018;
  Gene Symbol: APCS;
  Gene Name: amyloid P component, serum;
  Uniprot ID:  P02743;
  ENSP ID: ENSP00000255040
MNKPLLWISVLTSLLEAFAHTDLSGKVFVFPRESVTDHVNLITPLEKPLQNFTLCFRAYSDLSRAYSLFSYNTQGRDNELLVYKERVGEYSLYIGRHKVTSKVIEKFPAPVHICVSWESSSGIAEFWINGTPLVKKGLRQGYFVEAQPKIVLGQEQDSYGGKFDRSQSFVGEIGDLYMWDSVLPPENILSAYQGTPLPANILDWQALNYEIRGYVIIKPLVWV

SEQ ID NO: 4604 - protein, 1657 aa, Homo sapiens
  Payload ID: 1019;
  Gene Symbol: ALS2;
  Gene Name: amyotrophic lateral sclerosis 2 (juvenile);
  Uniprot ID:  Q96Q42;
  ENSP ID: ENSP00000264276
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSIADSEASPLLAVRILQLACGEEHTLALSISREIWAWGTGCQLGLITTAFPVTKPQKVEHLAGRVVLQVACGAFHSLALVQCLPSQDLKPVPERCNQCSQLLITMTDKEDHVIISDSHCCPLGVTLTESQAENHASTALSPSTETLDRQEEVFENTLVANDQSVATELNAVSAQITSSDAMSSQQNVMGTTEISSARNIPSYPDTQAVNEYLRKLSDHSVREDSEHGEKPVPSQPLLEEAIPNLHSPPTTSTSALNSLVVSCASAVGVRVAATYEAGALSLKKVMNFYSTTPCETGAQAGSSAIGPEGLKDSREEQVKQESMQGKKSSSLVDIREEETEGGSRRLSLPGLLSQVSPRLLRKAARVKTRTVVLTPTYSGEADALLPSLRTEVWTWGKGKEGQLGHGDVLPRLQPLCVKCLDGKEVIHLEAGGYHSLALTAKSQVYSWGSNTFGQLGHSDFPTTVPRLAKISSENGVWSIAAGRDYSLFLVDTEDFQPGLYYSGRQDPTEGDNLPENHSGSKTPVLLSCSKLGYISRVTAGKDSYLALVDKNIMGYIASLHELATTERRFYSKLSDIKSQILRPLLSLENLGTTTTVQLLQEVASRFSKLCYLIGQHGASLSSFLHGVKEARSLVILKHSSLFLDSYTEYCTSITNFLVMGGFQLLAKPAIDFLNKNQELLQDLSEVNDENTQLMEILNTLFFLPIRRLHNYAKVLLKLATCFEVASPEYQKLQDSSSCYECLALHLGRKRKEAEYTLGFWKTFPGKMTDSLRKPERRLLCESSNRALSLQHAGRFSVNWFILFNDALVHAQFSTHHVFPLATLWAEPLSEEAGGVNGLKITTPEEQFTLISSTPQEKTKWLRAISQAVDQALRGMSDLPPYGSGSSVQRQEPPISRSAKYTFYKDPRLKDATYDGRWLSGKPHGRGVLKWPDGKMYSGMFRNGLEDGYGEYRIPNKAMNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKGTLTMPNGDYIEGYFSGEWGSGIKITGTYFKPSLYESDKDRPKVFRKLGNLAVPADEKWKAVFDECWRQLGCEGPGQGEVWKAWDNIAVALTTSRRQHRDSPEILSRSQTQTLESLEFIPQHVGAFSVEKYDDIRKYLIKACDTPLHPLGRLVETLVAVYRMTYVGVGANRRLLQEAVKEIKSYLKRIFQLVRFLFPELPEEGSTIPLSAPLPTERKSFCTGKSDSRSESPEPGYVVTSSGLLLPVLLPRLYPPLFMLYALDNDREEDIYWECVLRLNKQPDIALLGFLGVQRKFWPATLSILGESKKVLPTTKDACFASAVECLQQISTTFTPSDKLKVIQQTFEEISQSVLASLHEDFLWSMDDLFPVFLYVVLRARIRNLGSEVHLIEDLMDPYLQHGEQGIMFTTLKACYYQIQREKLN

SEQ ID NO: 4605 - protein, 139 aa, Homo sapiens
  Payload ID: 1019;
  Gene Symbol: ALS2;
  Gene Name: amyotrophic lateral sclerosis 2 (juvenile);
  ENSP ID: ENSP00000386384
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSI

SEQ ID NO: 4606 - protein, 106 aa, Homo sapiens
  Payload ID: 1019;
  Gene Symbol: ALS2;
  Gene Name: amyotrophic lateral sclerosis 2 (juvenile);
  ENSP ID: ENSP00000386948
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAV

SEQ ID NO: 4607 - protein, 585 aa, Homo sapiens
  Payload ID: 1019;
  Gene Symbol: ALS2;
  Gene Name: amyotrophic lateral sclerosis 2 (juvenile);
  ENSP ID: ENSP00000403832
  MOD_RES (1)..(1): Any amino acid
XLALVDKNIMGYIASLHELATTERRFYSKLSDIKSQILRPLLSLENLGTTTTVQLLQEVASRFSKLCYLIGQHGASLSSFLHGVKEARSLVILKHSSLFLDSYTEYCTSITNFLVMGGFQLLAKPAIDFLNKNQELLQDLSEVNDENTQLMEILNTLFFLPIRRLHNYAKVLLKLATCFEVASPEYQKLQDSSSCYECLALHLGRKRKEAEYTLGFWKTFPGKMTDSLRKPERRLLCESSNRALSLQHAGRFSVNWFILFNDALVHAQFSTHHVFPLATLWAEPLSEEAGGVNGLKITTPEEQFTLISSTPQEKTKWLRAISQAVDQALRGMSDLPPYGSGSSVQRQEPPISRSAKYTFYKDPRLKDATYDGRWLSGKPHGRGVLKWPDGKMYSGMFRNGLEDGYGEYRIPNKAMNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKDNSGLIEQVGKCSLLPYFLKVCEALVLFLL

SEQ ID NO: 4608 - protein, 396 aa, Homo sapiens
  Payload ID: 1019;
  Gene Symbol: ALS2;
  Gene Name: amyotrophic lateral sclerosis 2 (juvenile);
  Uniprot ID:  Q96Q42;
  ENSP ID: ENSP00000429223
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSIADSEASPLLAVRILQLACGEEHTLALSISREIWAWGTGCQLGLITTAFPVTKPQKVEHLAGRVVLQVACGAFHSLALVQCLPSQDLKPVPERCNQCSQLLITMTDKEDHVIISDSHCCPLGVTLTESQAENHASTALSPSTETLDRQEEVFENTLVANDQSVATELNAVSAQITSSDAMSSQQNVMGTTEISSARNIPSYPDTQAVNEYLRKLSDHSVREDSEHGEKPVPSQVPAQFYKIKVCLELNCMGFSLETLK

SEQ ID NO: 4609 - protein, 623 aa, Homo sapiens
  Payload ID: 1020;
  Gene Symbol: ALS2CR11;
  Gene Name: amyotrophic lateral sclerosis 2 (juvenile) chromosome region, candidate 11;
  Uniprot ID:  Q53TS8;
  ENSP ID: ENSP00000286195
MEPPQETNRPFSTLDNRSGQVQVLSATPLLQRNPYSSPDIMHIKGSEASSVPYALNQGTTALPKNKNQEGTGHRLLNMLRKTLKESDSEELEITQETPNLVPFGDVVGCLGIHIKNCRHFMPKISLQHYANLFIRISINKAVKCTKMCSLLSKNDEKNTVIKFDEVKYFSVQVPRRYDDKRNNILLELIQYDNREKRAFLLGSVQIHLYEVIQKGCFIEEVQVLHGNIFVCRLEVEFMFSYGNFGYGFSHQLKPLQKITEPSMFMNLAPPPERTDPVTKVITPQTVEYPAFLSPDLNVTVGTPAVQSSNQPSVVRLEKLQQQPRERLEKMKKEYRNLNTWIDKANYLESILMPKLEHKDSEETNIDEASENTKSNHPEEELENIVGVDIPLVNEEAETTANELLDNDSEKGLTIPTLNQSDQDNSTADASKNDESTPSPTEVHSLCTISNQETIKAGRIPPLGERQSESMPDRKMKNVFFPLEVKLKDNYPSILKADSSLSEVAFSPKEYNSPSFRPEYIEFKPKFQDCSDKFEDLHDMTSFTHLKKVKSRSRLLGKSSDDIHNHARHSARPYTAPEVNKQRESYSGKFTSRRMVSSGLVHINDKTSDYEMHKMRPKKIKRGY

SEQ ID NO: 4610 - protein, 550 aa, Homo sapiens
  Payload ID: 1020;
  Gene Symbol: ALS2CR11;
  Gene Name: amyotrophic lateral sclerosis 2 (juvenile) chromosome region, candidate 11;
  Uniprot ID:  Q53TS8;
  ENSP ID: ENSP00000399016
MEPPQETNRPFSTLDNRSGQVQVLSATPLLQRNPYSSPDIMHIKGSEASSVPYALNQGTTALPKNKNQEGTGHRLLNMLRKTLKESDSEELEITQETPNLVPFGDVVGCLGIHIKNCRHFMPKISLQHYANLFIRISINKAVKCTKMCSLLSKNDEKNTVIKFDEVKYFSVQVPRRYDDKRNNILLELIQYDNREKRAFLLGSVQIHLYEVIQKGCFIEEVQVLHGNIFVCRLEVEFMFSYGNFGYGFSHQLKPLQKITEPSMFMNLAPPPERTDPVTKVITPQTVEYPAFLSPDLNVTVGTPAVQSSNQPSVVRLEKLQQQPRERLEKMKKEYRNLNTWIDKANYLESILMPKLEHKDSEETNIDEASENTKSNHPEEELENIVGVDIPLVNEEAETTANELLDNDSEKGLTIPTLNQSDQDNSTADASKNDESTPSPTEVHSLCTISNQETIKAGRIPPLGERQSESMPDRKMKNVFFPLEVKLKDNYPSILKADSSLSEVNLRSICINPKSRNLDSSPTEISWQNNNLNLAERENTGLVSTRLKIKR

SEQ ID NO: 4611 - protein, 395 aa, Homo sapiens
  Payload ID: 1020;
  Gene Symbol: ALS2CR11;
  Gene Name: amyotrophic lateral sclerosis 2 (juvenile) chromosome region, candidate 11;
  Uniprot ID:  Q53TS8;
  ENSP ID: ENSP00000400672
MEPPQETNRPFSTLDNRSGQVQVLSATPLLQRNPYSSPDIMHIKGSEASSVPYALNQGTTALPKNKNQEGTGHRLLNMLRKTLKESDSEELEITQETPNLVPFGDVVGCLGIHIKNCRHFMPKISLQHYANLFIRISINKAVKCTKMCSLLSKNDEKNTVIKFDEVKYFSVQVPRRYDDKRNNILLELIQYDNREKRAFLLGSVQIHLYEVIQKGCFIEEVQVLHGNIFVCRLEVEFMFSYGNFGYGFSHQLKPLQKITEPSMFMNLAPPPERTDPVTKVITPQTVEYPAFLSPDLNVTVGTPAVQSSNQPSVVRLEKLQQQPRERLEKMKKEYRNLNTWIDKANYLESILMPKLEHKDSEETNIDEASENTKSNHPEEELENIVGVGGFFTKRI

SEQ ID NO: 4612 - protein, 1820 aa, Homo sapiens
  Payload ID: 1020;
  Gene Symbol: ALS2CR11;
  Gene Name: amyotrophic lateral sclerosis 2 (juvenile) chromosome region, candidate 11;
  Uniprot ID:  Q53TS8;
  ENSP ID: ENSP00000409937
MEPPQETNRPFSTLDNRSGQVQVLSATPLLQRNPYSSPDIMHIKGSEASSVPYALNQGTTALPKNKNQEGTGHRLLNMLRKTLKESDSEELEITQETPNLVPFGDVVGCLGIHIKNCRHFMPKISLQHYANLFIRISINKAVKCTKMCSLLSKNDEKNTVIKFDEVKYFSVQVPRRYDDKRNNILLELIQYDNREKRAFLLGSVQIHLYEVIQKGCFIEEVQVLHGNIFVCRLEVEFMFSYGNFGYGFSHQLKPLQKITEPSMFMNLAPPPERTDPVTKVITPQTVEYPAFLSPDLNVTVGTPAVQSSNQPSVVRLEKLQQQPRERLEKMKKEYRNLNTWIDKANYLESILMPKLEHKDSEETNIDEASENTKSNHPEEELENIVGVDIPLVNEEAETTANELLDNDSEKGLTIPTLNQSDQDNSTADASKNDESTPSPTEVHSLCTISNQETIKAGRIPPLGERQSESMPDRKMKNVFFPLEVKLKDNYPSILKADSSLSEVAFSPKEYNSPSFRPEYIEFKPKFQFQKFNKNGFDPFLRNINKMSVRKRKDQDIYKYRNILGAEVIEHEDQDPPYPAQSKTAGPANTTWAHDPNIFTTKMLETENKLAPDPTINTIKGLDTKNSLKENLPNVSLPSIKGESSRAGNVQANTCHLSKSLNFTPHIEYLKQSMILKSILSENLQDLSDKLFSKPEVSMNSEAREKSSSPLLSIHDKSSSSMEDNVLEKKQDLNNWLSEKDILNSKTTLSQIIKNIPADSFSEGSQIIENIPADSLLEGGQVIKNIPEYSLSEGGQIIKNIPADSFLESGPGQSPEVEEHVSKKHFEADERDFPIKKNSSTKKKHLISEVPNSKSGSSGTVHDYIMRQIFTAPIFSELEIEVKEPSETPMNLENQLPTPWKRSLSSHILFHEENADEIELPQPRSATSQIIQAFPIDTLLESGIIKVIELDKEHHKSSLLGTGITSPKGNLKDSQEYYSEIRSETEPLSEQSIPIIPKDTTSVSRAEFIQEDQNMFPQDSSYYSIANKELYLPRNGQRLCKDKNDLSSTLESLTNSLMDKLSESDEIMLKSFLKNIFNVFFKYNHSERRGQPEKELERLIQPSFTSDTEHLEELQEDFDKADKLDRKPILSPKLRVFLEELSESEVKHLKSELSKQIQHYLVERLSESGHITKEDLPKIYQNLYLMNEKAEQKGPNSFQGKYSETVKEIMSFVNNFNHHFIDKHLEIKLRSFLKEILQNYFLKNISESSLFNETASETIYPNISSLRTKSVSISFHELEQDISKGSFGRRFEINMKYPLSKSLQNYLIALSENELLHLKADLSKHLQSLFIEKLSKSGLMTKKQLEGINQHINLLNSSSIPLKYIKTHLPFRDDCHFVEKHSEKQNKYSRIVQQTTLQTVSEDKLREAELIREKEKKYFPLQNLKGNSSLIKEQKSYYTKEEAKTPSLIKVQPSSNENIQASPLSKSSEILTDILLKKLRKEHVFTQLPQAENSVHKTEIQDPYSWGGKSKITQSKAWCEKTLKMKSLDRKEHVNIYKWTVQEKPEAVLTSYPRIPNARMPREDEYLNRITFPSWQSSTLTHFNTETGEKSKLEDQYCQTLKGNNNNNKKHLVTFAQYKKEIQTLYIKPDEICSEKCAKFPEIQSFQYKVVEDEKNLKPHLFPELFKIEDLKPKVRKERDRVAQPKKSFNKIVRILPTTLPTTRIHLKKSVPRTLLHWTARRTIHDCSDKFEDLHDMTSFTHLKKVKSRSRLLGKSSDDIHNHARHSARPYTAPEVNKQRESYSGKFTSRRMVSSGLVHINDKTSDYEMHKMRPKKIKRGY

SEQ ID NO: 4613 - protein, 445 aa, Homo sapiens
  Payload ID: 1021;
  Gene Symbol: ALS2CR12;
  Gene Name: amyotrophic lateral sclerosis 2 (juvenile) chromosome region, candidate 12;
  Uniprot ID:  Q96Q35;
  ENSP ID: ENSP00000286190
MYPNPLIYCTCWDPWNLGPRKLIKTPQLPRKNSTGSSKLTPLVPAPKNHNYLQPTKPVVSPKMKIHSARQEETNKSFYEVINVSPGYQLVRNREQISVTLGDEMFDRKKRWESEIPDKGRFSRTNIISDLEEQISELTAIIEQMNRDHQSAQKLLSSEMDLRCAEMKQNFENKNRELKEAHEAELSELENNYKAALKAEKLAAQEKLEEMGKEYKYLKNMFRTYQDSIYDEMEEKWSKQKAKWKKDEKFERENILLQQKKKMTKKFEMESGEEDKKINESCSAVFENFIQEKEELLKQHQSDTLQLEELRKTKEVPWRRDQINRHWHDVLQQLLLMQVMQEELHAQALILESLNTNLYYTQLELQKEKAIVGNLEKMLQTKFAETEEKYKHTIQILTEENIHLKQKIISKNEEICEGCSGRLASITVSKDDSDTVQDGSKKGQES

SEQ ID NO: 4614 - protein, 422 aa, Homo sapiens
  Payload ID: 1021;
  Gene Symbol: ALS2CR12;
  Gene Name: amyotrophic lateral sclerosis 2 (juvenile) chromosome region, candidate 12;
  Uniprot ID:  Q96Q35;
  ENSP ID: ENSP00000376086
MYPNPLIYCTCWDPWNLGPRKLIKTPQLPRKNSTGSSKLTPLVPAPKNHNYLQPTKPVVSPKMKIHSARQEETNKSFYEVINVSPGYQLVRNREQISVTLGDEMFDRKKRWESEIPDKGRFSRTNIISDLEEQISELTAIIEQMNRDHQSAQKLLSSEMDLRCAEMKQNFENKNRELKEAHEAELSELENNYKAALKAEKLAAQEKLEEMGKEYKYLKNMFRTYQDSIYDEMEEKWSKQKAKWKKDEKFERENILLQQKKKMTKKFEMESGEEDKKINESCSAVFENFIQEKEELLKQHQSDTLQLEELRKTKEVMQEELHAQALILESLNTNLYYTQLELQKEKAIVGNLEKMLQTKFAETEEKYKHTIQILTEENIHLKQKIISKNEEICEGCSGRLASITVSKDDSDTVQDGSKKGQES

SEQ ID NO: 4615 - protein, 445 aa, Homo sapiens; identical to SEQ ID NO: 4613
  Payload ID: 1021;
  Gene Symbol: ALS2CR12;
  Gene Name: amyotrophic lateral sclerosis 2 (juvenile) chromosome region, candidate 12;
  Uniprot ID:  Q96Q35;
  ENSP ID: ENSP00000385098

SEQ ID NO: 4616 - protein, 143 aa, Homo sapiens
  Payload ID: 1021;
  Gene Symbol: ALS2CR12;
  Gene Name: amyotrophic lateral sclerosis 2 (juvenile) chromosome region, candidate 12;
  ENSP ID: ENSP00000393945
MKIHSARQEETNKSFYEVINVSPGYQLVRNREQISVTLGDEMFDRKKRWESEIPDKGRFSRELKEAHEAELSELENNYKAALKAEKLAAQEKLEEMGKEYKYLKNMFRTYQDSIYDEMEEKWSKQKAKWKKDEKFERENILLQ

SEQ ID NO: 4617 - protein, 124 aa, Homo sapiens
  Payload ID: 1021;
  Gene Symbol: ALS2CR12;
  Gene Name: amyotrophic lateral sclerosis 2 (juvenile) chromosome region, candidate 12;
  ENSP ID: ENSP00000402327
  MOD_RES (1)..(1): Any amino acid
XSIYDEMEEKWSKQKAKWKKDEKFERENILLQQKKKMTKKFEMESGEEDKKINESCSAVFENFIQEKEELLKQHQSDTLQLEELRKTKEVMQEELHAQALILESLNTNLYYTQLELQKEAKDNF

SEQ ID NO: 4618 - protein, 49 aa, Homo sapiens
  Payload ID: 1021;
  Gene Symbol: ALS2CR12;
  Gene Name: amyotrophic lateral sclerosis 2 (juvenile) chromosome region, candidate 12;
  ENSP ID: ENSP00000407585
MYPNPLIYCTCWDPWNLGPRKLIKTPQLPRKNSTGSSKLTPLVPAPKNH

SEQ ID NO: 4619 - protein, 422 aa, Homo sapiens; identical to SEQ ID NO: 4614
  Payload ID: 1021;
  Gene Symbol: ALS2CR12;
  Gene Name: amyotrophic lateral sclerosis 2 (juvenile) chromosome region, candidate 12;
  Uniprot ID:  Q96Q35;
  ENSP ID: ENSP00000412073

SEQ ID NO: 4620 - protein, 1944 aa, Homo sapiens
  Payload ID: 1022;
  Gene Symbol: ANAPC1;
  Gene Name: anaphase promoting complex subunit 1;
  Uniprot ID:  Q9H1A4;
  ENSP ID: ENSP00000339109
MSNFYEERTTMIAARDLQEFVPFGRDHCKHHPNALNLQLRQLQPASELWSSDGAAGLVGSLQEVTIHEKQKESWQLRKGVSEIGEDVDYDEELYVAGNMVIWSKGSKSQALAVYKAFTVDSPVQQALWCDFIISQDKSEKAYSSNEVEKCICILQSSCINMHSIEGKDYIASLPFQVANVWPTKYGLLFERSASSHEVPPGSPREPLPTMFSMLHPLDEITPLVCKSGSLFGSSRVQYVVDHAMKIVFLNTDPSIVMTYDAVQNVHSVWTLRRVKSEEENVVLKFSEQGGTPQNVATSSSLTAHLRSLSKGDSPVTSPFQNYSSIHSQSRSTSSPSLHSRSPSISNMAALSRAHSPALGVHSFSGVQRFNISSHNQSPKRHSISHSPNSNSNGSFLAPETEPIVPELCIDHLWTETITNIREKNSQASKVFITSDLCGQKFLCFLVESQLQLRCVKFQESNDKTQLIFGSVTNIPAKDAAPVEKIDTMLVLEGSGNLVLYTGVVRVGKVFIPGLPAPSLTMSNTMPRPSTPLDGVSTPKPLSKLLGSLDEVVLLSPVPELRDSSKLHDSLYNEDCTFQQLGTYIHSIRDPVHNRVTLELSNGSMVRITIPEIATSELVQTCLQAIKFILPKEIAVQMLVKWYNVHSAPGGPSYHSEWNLFVTCLMNMMGYNTDRLAWTRNFDFEGSLSPVIAPKKARPSETGSDDDWEYLLNSDYHQNVESHLLNRSLCLSPSEASQMKDEDFSQNLSLDSSTLLFTHIPAIFFVLHLVYEELKLNTLMGEGICSLVELLVQLARDLKLGPYVDHYYRDYPTLVRTTGQVCTIDPGQTGFMHHPSFFTSEPPSIYQWVSSCLKGEGMPPYPYLPGICERSRLVVLSIALYILGDESLVSDESSQYLTRITIAPQKLQVEQEENRFSFRHSTSVSSLAERLVVWMTNVGFTLRDLETLPFGIALPIRDAIYHCREQPASDWPEAVCLLIGRQDLSKQACEGNLPKGKSVLSSDVPSGTETEEEDDGMNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIHIPALLPPTSTELDVPHNVQVAAVVGIGLVYQGTAHRHTAEVLLAEIGRPPGPEMEYCTDRESYSLAAGLALGMVCLGHGSNLIGMSDLNVPEQLYQYMVGGHRRFQTGMHREKHKSPSYQIKEGDTINVDVTCPGATLALAMIYLKTNNRSIADWLRAPDTMYLLDFVKPEFLLLRTLARCLILWDDILPNSKWVDSNVPQIIRENSISLSEIELPCSEDLNLETLSQAHVYIIAGACLSLGFRFAGSENLSAFNCLHKFAKDFMTYLSAPNASVTGPHNLETCLSVVLLSLAMVMAGSGNLKVLQLCRFLHMKTGGEMNYGFHLAHHMALGLLFLGGGRYSLSTSNSSIAALLCALYPHFPAHSTDNRYHLQALRHLYVLAAEPRLLVPVDVDTNTPCYALLEVTYKGTQWYEQTKEELMAPTLLPELHLLKQIKVKGPRYWELLIDLSKGTQHLKSILSKDGVLYVKLRAGQLSYKEDPMGWQSLLAQTVANRNSEARAFKPETISAFTSDPALLSFAEYFCKPTVNMGQKQEILDLFSSVLYECVTQETPEMLPAYIAMDQAIRRLGRREMSETSELWQIKLVLEFFSSRSHQERLQNHPKRGLFMNSEFLPVVKCTIDNTLDQWLQVGGDMCVHAYLSGQPLEESQLSMLACFLVYHSVPAPQHLPPIGLEGSTSFAELLFKFKQLKMPVRALLRLAPLLLGNPQPMVM

SEQ ID NO: 4621 - protein, 1452 aa, Homo sapiens
  Payload ID: 1022;
  Gene Symbol: ANAPC1;
  Gene Name: anaphase promoting complex subunit 1;
  ENSP ID: ENSP00000396695
  MOD_RES (1)..(1): Any amino acid
XIFGSVTNIPAKDAAPVEKIDTMLVLEGSGNLVLYTGVVRVGKVFIPGLPAPSLTMSNTMPRPSTPLDGVSTPKPLSKLLGSLDEVVLLSPVPELRDSSKLHDSLYNEDCTFQQLGTYIHSIRDPVHNRVTLELSNGSMVRITIPEIATSELVQTCLQAIKFILPKEIAVQMLVKWYNVHSAPGGPSYHSEWNLFVTCLMNMMGYNTDRLAWTRNFDFEGSLSPVIAPKKARPSETGSDDDWEYLLNSDYHQNVESHLLNRSLCLSPSEASQMKDEDFSQNLSLDSSTLLFTHIPAIFFVLHLVYEELKLNTLMGEGICSLVELLVQLARDLKLGPYVDHYYRDYPTLVRTTGQVCTIDPGQTGFMHHPSFFTSEPPSIYQWVSSCLKGEGMPPYPYLPGICERSRLVVLSIALYILGDESLVSDESSQYLTRITIAPQKLQVEQEENRFSFRHSTSVSSLAERLVVWMTNVGFTLRDLETLPFGIALPIRDAIYHCREQPASDWPEAVCLLIGRQDLSKQACEGNLPKGKSVLSSDVPSGTETEEEDDGMNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIHIPALLPPTSTELDVPHNVQVAAVVGIGLVYQGTAHRHTAEVLLAEIGRPPGPEMEYCTDRESYSLAAGLALGMVCLGHGSNLIGMSDLNVPEQLYQYMVGGHRRFQTGMHREKHKSPSYQIKEGDTINVDVTCPGATLALAMIYLKTNNRSIADWLRAPDTMYLLDFVKPEFLLLRTLARCLILWDDILPNSKWVDSNVPQIIRENSISLSEIELPCSEDLNLETLSQAHVYIIAGACLSLGFRFAGSENLSAFNCLHKFAKDFMTYLSAPNASVTGPHNLETCLSVVLLSLAMVMAGSGNLKVLQLCRFLHMKTGGEMNYGFHLAHHMALGLLFLGGGRYSLSTSNSSIAALLCALYPHFPAHSTDNRYHLQALRHLYVLAAEPRLLVPVDVDTNTPCYALLEVTYKGTQWYEQTKEELMAPTLLPELHLLKQIKVKGPRYWELLIDLSKGTQHLKSILSKDGVLYVKLRAGQLSYKEDPMGWQSLLAQTVANRNSEARAFKPETISAFTSDPALLSFAEYFCKPTVNMGQKQEILDLFSSVLYECVTQETPEMLPAYIAMDQAIRRLGRREMSETSELWQIKLVLEFFSSRSHQERLQNHPKRGLFMNSEFLPVVKCTIDNTLDQWLQVGGDMCVHAYLSGQPLEESQLSMLACFLVYHSVPAPQHLPPIGLEGLLKDLAGDSG

SEQ ID NO: 4622 - protein, 149 aa, Homo sapiens
  Payload ID: 1022;
  Gene Symbol: ANAPC1;
  Gene Name: anaphase promoting complex subunit 1;
  ENSP ID: ENSP00000405375
MSNFYEERTTMIAARDLQEFVPFGRDHCKHHPNALNLQLRQLQPASELWSSDGAAGLVGSLQEVTIHEKQKESWQLRKGVSEIGEDVDYDEELYVAGNMVIWSKGSKSQALAVYKAFTVDSPVQQALWCDFIISQDKSEKAYSCKCLAH

SEQ ID NO: 4623 - protein, 149 aa, Homo sapiens; identical to SEQ ID NO: 4622
  Payload ID: 1022;
  Gene Symbol: ANAPC1;
  Gene Name: anaphase promoting complex subunit 1;
  ENSP ID: ENSP00000486322

SEQ ID NO: 4624 - protein, 185 aa, Homo sapiens
  Payload ID: 1023;
  Gene Symbol: ANAPC10;
  Gene Name: anaphase promoting complex subunit 10;
  Uniprot ID:  Q9UM13;
  ENSP ID: ENSP00000310071
MTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRQLELVEPSGWIHVPLTDNHKKPTRTFMIQIAVLANHQNGRDTHMRQIKIYTPVEESSIGKFPRCTTIDFMMYRSIR

SEQ ID NO: 4625 - protein, 185 aa, Homo sapiens; identical to SEQ ID NO: 4624
  Payload ID: 1023;
  Gene Symbol: ANAPC10;
  Gene Name: anaphase promoting complex subunit 10;
  Uniprot ID:  Q9UM13;
  ENSP ID: ENSP00000403891

SEQ ID NO: 4626 - protein, 158 aa, Homo sapiens
  Payload ID: 1023;
  Gene Symbol: ANAPC10;
  Gene Name: anaphase promoting complex subunit 10;
  ENSP ID: ENSP00000421609
MTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRQLELVEPSGWIHVPLTDNHKKPTRTFMIQIAVLANHQNGRDTHMRQIKI

SEQ ID NO: 4627 - protein, 158 aa, Homo sapiens; identical to SEQ ID NO: 4626
  Payload ID: 1023;
  Gene Symbol: ANAPC10;
  Gene Name: anaphase promoting complex subunit 10;
  ENSP ID: ENSP00000423043

SEQ ID NO: 4628 - protein, 109 aa, Homo sapiens
  Payload ID: 1023;
  Gene Symbol: ANAPC10;
  Gene Name: anaphase promoting complex subunit 10;
  ENSP ID: ENSP00000423223
MTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIR

SEQ ID NO: 4629 - protein, 185 aa, Homo sapiens; identical to SEQ ID NO: 4624
  Payload ID: 1023;
  Gene Symbol: ANAPC10;
  Gene Name: anaphase promoting complex subunit 10;
  Uniprot ID:  Q9UM13;
  ENSP ID: ENSP00000423995

SEQ ID NO: 4630 - protein, 68 aa, Homo sapiens
  Payload ID: 1023;
  Gene Symbol: ANAPC10;
  Gene Name: anaphase promoting complex subunit 10;
  ENSP ID: ENSP00000424463
MTTPNKTPPGADPKQLERTGTVREIGSQAVWSLSSCKPGFGVDQLRDDNLETYWQSDGSQPHLVNIQF

SEQ ID NO: 4631 - protein, 126 aa, Homo sapiens
  Payload ID: 1023;
  Gene Symbol: ANAPC10;
  Gene Name: anaphase promoting complex subunit 10;
  ENSP ID: ENSP00000425459
MTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRPHVLHVNEESMNLQVSG

SEQ ID NO: 4632 - protein, 185 aa, Homo sapiens; identical to SEQ ID NO: 4624
  Payload ID: 1023;
  Gene Symbol: ANAPC10;
  Gene Name: anaphase promoting complex subunit 10;
  Uniprot ID:  Q9UM13;
  ENSP ID: ENSP00000478501

SEQ ID NO: 4633 - protein, 84 aa, Homo sapiens
  Payload ID: 1024;
  Gene Symbol: ANAPC11;
  Gene Name: anaphase promoting complex subunit 11;
  Uniprot ID:  Q9NYG5;
  ENSP ID: ENSP00000339695
MKVKIKCWNGVATWLWVANDENCGICRMAFNGCCPDCKVPGDDCPLVWGQCSHCFHMHCILKWLHAQQVQQHCPMCRQEWKFKE

SEQ ID NO: 4634 - protein, 196 aa, Homo sapiens
  Payload ID: 1024;
  Gene Symbol: ANAPC11;
  Gene Name: anaphase promoting complex subunit 11;
  Uniprot ID:  Q9NYG5;
  ENSP ID: ENSP00000349957
MKVKIKCWNGVATWLWVANDENCGICRMAFNGCCPDCPLHGESISRCLGWCPQPVPVLGGRAHPQVPINTASPTPGQHTGSLMSREESSRSPDPTPPALDQETSSLLRCTSPWCLDHSCDLFGITDQVSADGPRACRQGARRRLPAGVGPVLPLLPHALHPQVAARTAGAAALPHVPPGMEVQGVRPDLALAGGAS

SEQ ID NO: 4635 - protein, 84 aa, Homo sapiens; identical to SEQ ID NO: 4633
  Payload ID: 1024;
  Gene Symbol: ANAPC11;
  Gene Name: anaphase promoting complex subunit 11;
  Uniprot ID:  Q9NYG5;
  ENSP ID: ENSP00000376181

SEQ ID NO: 4636 - protein, 84 aa, Homo sapiens; identical to SEQ ID NO: 4633
  Payload ID: 1024;
  Gene Symbol: ANAPC11;
  Gene Name: anaphase promoting complex subunit 11;
  Uniprot ID:  Q9NYG5;
  ENSP ID: ENSP00000458143

SEQ ID NO: 4637 - protein, 84 aa, Homo sapiens; identical to SEQ ID NO: 4633
  Payload ID: 1024;
  Gene Symbol: ANAPC11;
  Gene Name: anaphase promoting complex subunit 11;
  Uniprot ID:  Q9NYG5;
  ENSP ID: ENSP00000458265

SEQ ID NO: 4638 - protein, 84 aa, Homo sapiens; identical to SEQ ID NO: 4633
  Payload ID: 1024;
  Gene Symbol: ANAPC11;
  Gene Name: anaphase promoting complex subunit 11;
  Uniprot ID:  Q9NYG5;
  ENSP ID: ENSP00000458515

SEQ ID NO: 4639 - protein, 84 aa, Homo sapiens; identical to SEQ ID NO: 4633
  Payload ID: 1024;
  Gene Symbol: ANAPC11;
  Gene Name: anaphase promoting complex subunit 11;
  Uniprot ID:  Q9NYG5;
  ENSP ID: ENSP00000459200

SEQ ID NO: 4640 - protein, 84 aa, Homo sapiens; identical to SEQ ID NO: 4633
  Payload ID: 1024;
  Gene Symbol: ANAPC11;
  Gene Name: anaphase promoting complex subunit 11;
  Uniprot ID:  Q9NYG5;
  ENSP ID: ENSP00000460064

SEQ ID NO: 4641 - protein, 84 aa, Homo sapiens; identical to SEQ ID NO: 4633
  Payload ID: 1024;
  Gene Symbol: ANAPC11;
  Gene Name: anaphase promoting complex subunit 11;
  Uniprot ID:  Q9NYG5;
  ENSP ID: ENSP00000460678

SEQ ID NO: 4642 - protein, 84 aa, Homo sapiens; identical to SEQ ID NO: 4633
  Payload ID: 1024;
  Gene Symbol: ANAPC11;
  Gene Name: anaphase promoting complex subunit 11;
  Uniprot ID:  Q9NYG5;
  ENSP ID: ENSP00000461648

SEQ ID NO: 4643 - protein, 44 aa, Homo sapiens
  Payload ID: 1024;
  Gene Symbol: ANAPC11;
  Gene Name: anaphase promoting complex subunit 11;
  ENSP ID: ENSP00000462250
MKVKIKCWNGVATWLWVANDENCGICRMAFNGCCPDCECPLHAV

SEQ ID NO: 4644 - protein, 111 aa, Homo sapiens
  Payload ID: 1024;
  Gene Symbol: ANAPC11;
  Gene Name: anaphase promoting complex subunit 11;
  ENSP ID: ENSP00000462527
MKVKIKCWNGVATWLWVANDENCGICRMAFNGCCPDCWSAMARSRLAATSASRVQTVLLPQPSKQLGLQACARRRLPAGVGPVLPLLPHALHPQVAARTAGAAALPHVPPG

SEQ ID NO: 4645 - protein, 44 aa, Homo sapiens; identical to SEQ ID NO: 4643
  Payload ID: 1024;
  Gene Symbol: ANAPC11;
  Gene Name: anaphase promoting complex subunit 11;
  ENSP ID: ENSP00000462691

SEQ ID NO: 4646 - protein, 44 aa, Homo sapiens; identical to SEQ ID NO: 4643
  Payload ID: 1024;
  Gene Symbol: ANAPC11;
  Gene Name: anaphase promoting complex subunit 11;
  ENSP ID: ENSP00000463357

SEQ ID NO: 4647 - protein, 84 aa, Homo sapiens; identical to SEQ ID NO: 4633
  Payload ID: 1024;
  Gene Symbol: ANAPC11;
  Gene Name: anaphase promoting complex subunit 11;
  Uniprot ID:  Q9NYG5;
  ENSP ID: ENSP00000463567

SEQ ID NO: 4648 - protein, 84 aa, Homo sapiens; identical to SEQ ID NO: 4633
  Payload ID: 1024;
  Gene Symbol: ANAPC11;
  Gene Name: anaphase promoting complex subunit 11;
  Uniprot ID:  Q9NYG5;
  ENSP ID: ENSP00000463598

SEQ ID NO: 4649 - protein, 84 aa, Homo sapiens; identical to SEQ ID NO: 4633
  Payload ID: 1024;
  Gene Symbol: ANAPC11;
  Gene Name: anaphase promoting complex subunit 11;
  Uniprot ID:  Q9NYG5;
  ENSP ID: ENSP00000463640

SEQ ID NO: 4650 - protein, 44 aa, Homo sapiens; identical to SEQ ID NO: 4643
  Payload ID: 1024;
  Gene Symbol: ANAPC11;
  Gene Name: anaphase promoting complex subunit 11;
  ENSP ID: ENSP00000463889

SEQ ID NO: 4651 - protein, 44 aa, Homo sapiens; identical to SEQ ID NO: 4643
  Payload ID: 1024;
  Gene Symbol: ANAPC11;
  Gene Name: anaphase promoting complex subunit 11;
  ENSP ID: ENSP00000464403

SEQ ID NO: 4652 - protein, 72 aa, Homo sapiens
  Payload ID: 1024;
  Gene Symbol: ANAPC11;
  Gene Name: anaphase promoting complex subunit 11;
  ENSP ID: ENSP00000464519
MKVKIKCWNGVATWLWVANDENCGICRMAFNGCCPDCPLHGESISRCLGWCPQPVPVLGGRAHPQARCPATT

SEQ ID NO: 4653 - protein, 84 aa, Homo sapiens; identical to SEQ ID NO: 4633
  Payload ID: 1024;
  Gene Symbol: ANAPC11;
  Gene Name: anaphase promoting complex subunit 11;
  Uniprot ID:  Q9NYG5;
  ENSP ID: ENSP00000464615

SEQ ID NO: 4654 - protein, 89 aa, Homo sapiens
  Payload ID: 1024;
  Gene Symbol: ANAPC11;
  Gene Name: anaphase promoting complex subunit 11;
  ENSP ID: ENSP00000484031
MRTVASAGWHLTDAALTVSVPSMLSERPRLQGARRRLPAGVGPVLPLLPHALHPQVAARTAGAAALPHVPPGMEVQGVRPDLALAGGAS

SEQ ID NO: 4655 - protein, 74 aa, Homo sapiens
  Payload ID: 1025;
  Gene Symbol: ANAPC13;
  Gene Name: anaphase promoting complex subunit 13;
  Uniprot ID:  Q9BS18;
  ENSP ID: ENSP00000346987
MDSEVQRDGRILDLIDDAWREDKLPYEDVAIPLNELPEPEQDNGGTTESVKEQEMKWTDLALQYLHENVPPIGN

SEQ ID NO: 4656 - protein, 74 aa, Homo sapiens; identical to SEQ ID NO: 4655
  Payload ID: 1025;
  Gene Symbol: ANAPC13;
  Gene Name: anaphase promoting complex subunit 13;
  Uniprot ID:  Q9BS18;
  ENSP ID: ENSP00000421760

SEQ ID NO: 4657 - protein, 74 aa, Homo sapiens; identical to SEQ ID NO: 4655
  Payload ID: 1025;
  Gene Symbol: ANAPC13;
  Gene Name: anaphase promoting complex subunit 13;
  Uniprot ID:  Q9BS18;
  ENSP ID: ENSP00000421842

SEQ ID NO: 4658 - protein, 74 aa, Homo sapiens; identical to SEQ ID NO: 4655
  Payload ID: 1025;
  Gene Symbol: ANAPC13;
  Gene Name: anaphase promoting complex subunit 13;
  Uniprot ID:  Q9BS18;
  ENSP ID: ENSP00000427327

SEQ ID NO: 4659 - protein, 121 aa, Homo sapiens
  Payload ID: 1026;
  Gene Symbol: ANAPC15;
  Gene Name: anaphase promoting complex subunit 15;
  Uniprot ID:  P60006;
  ENSP ID: ENSP00000227618
MSTLFPSLFPRVTETLWFNLDRPCVEETELQQQEQQHQAWLQSIAEKDNNLVPIGKPASEHYDDEEEEDDEDDEDSEEDSEDDEDMQDMDEMNDYNESPDDGEVNEVDMEGNEQDQDQWMI

SEQ ID NO: 4660 - protein, 92 aa, Homo sapiens
  Payload ID: 1026;
  Gene Symbol: ANAPC15;
  Gene Name: anaphase promoting complex subunit 15;
  ENSP ID: ENSP00000389730
MSTLFPSLFPRVTETLWFNLDRPCVEETELQQQEQQHQAWLQSIAEKDNNLVPIGKPASEACRAYRLCPAHQHYDDEEEEDDEDDEDSEEDS

SEQ ID NO: 4661 - protein, 190 aa, Homo sapiens
  Payload ID: 1026;
  Gene Symbol: ANAPC15;
  Gene Name: anaphase promoting complex subunit 15;
  ENSP ID: ENSP00000437360
MSTLFPSLFPRVTETLWFNLDRPCVEETELQQQEQQHQAWLQSIAEKDNNLVPIGKPASEHYDDEEEEDDEDDEDSEEDSEDDEDMQDMDEMNDYNESPDDGEVNEVHLSVLPTCGLYHSHPKQLCPESIKLSHSFMPHVYMWLALPFPPPSPSAWPTQNFQIQFKCCSFSMKSQAETTTLSFRFMKGLC

SEQ ID NO: 4662 - protein, 123 aa, Homo sapiens
  Payload ID: 1026;
  Gene Symbol: ANAPC15;
  Gene Name: anaphase promoting complex subunit 15;
  ENSP ID: ENSP00000437683
MSTLFPSLFPRVTETLWFNLDRPCVEETELQQQEQQHQAWLQSIAEKDNNLVPIGKPASEACRAYRLCPAHQHYDDEEEEDDEDDEDSEEDSEDDEDMQDMDEMNDYNESPDDGEVNEVGKGY

SEQ ID NO: 4663 - protein, 65 aa, Homo sapiens
  Payload ID: 1026;
  Gene Symbol: ANAPC15;
  Gene Name: anaphase promoting complex subunit 15;
  ENSP ID: ENSP00000439362
MSTLFPSLFPRVTETLWFNLDRPCVEETELQQQEQQHQAWLQSIAEKDNNLVPIGKPASEHYDDE

SEQ ID NO: 4664 - protein, 125 aa, Homo sapiens
  Payload ID: 1026;
  Gene Symbol: ANAPC15;
  Gene Name: anaphase promoting complex subunit 15;
  Uniprot ID:  P60006;
  ENSP ID: ENSP00000439403
MSTLFPSLFPRVTETLWFNLDRPCVEETELQQQEQQHQAWLQSIAEKDNNLVPIGKPASEHYDDEEEEDDEDDEDSEEDSEDDEDMQDMDEMNDYNESPDDGEVNEPPLQVDMEGNEQDQDQWMI

SEQ ID NO: 4665 - protein, 121 aa, Homo sapiens; identical to SEQ ID NO: 4659
  Payload ID: 1026;
  Gene Symbol: ANAPC15;
  Gene Name: anaphase promoting complex subunit 15;
  Uniprot ID:  P60006;
  ENSP ID: ENSP00000440002

SEQ ID NO: 4666 - protein, 44 aa, Homo sapiens
  Payload ID: 1026;
  Gene Symbol: ANAPC15;
  Gene Name: anaphase promoting complex subunit 15;
  ENSP ID: ENSP00000440380
MSTLFPSLFPRVTETLWFNLDRPCVEETELQQQEQQHQAWLQSI

SEQ ID NO: 4667 - protein, 121 aa, Homo sapiens; identical to SEQ ID NO: 4659
  Payload ID: 1026;
  Gene Symbol: ANAPC15;
  Gene Name: anaphase promoting complex subunit 15;
  Uniprot ID:  P60006;
  ENSP ID: ENSP00000440983

SEQ ID NO: 4668 - protein, 105 aa, Homo sapiens
  Payload ID: 1026;
  Gene Symbol: ANAPC15;
  Gene Name: anaphase promoting complex subunit 15;
  ENSP ID: ENSP00000441774
MQDMDEMNDYNESPDDGEVNEVHLSVLPTCGLYHSHPKQLCPESIKLSHSFMPHVYMWLALPFPPPSPSAWPTQNFQIQFKCCSFSMKSQAETTTLSFRFMKGLC

SEQ ID NO: 4669 - protein, 121 aa, Homo sapiens; identical to SEQ ID NO: 4659
  Payload ID: 1026;
  Gene Symbol: ANAPC15;
  Gene Name: anaphase promoting complex subunit 15;
  Uniprot ID:  P60006;
  ENSP ID: ENSP00000443383

SEQ ID NO: 4670 - protein, 125 aa, Homo sapiens; identical to SEQ ID NO: 4664
  Payload ID: 1026;
  Gene Symbol: ANAPC15;
  Gene Name: anaphase promoting complex subunit 15;
  Uniprot ID:  P60006;
  ENSP ID: ENSP00000443645

SEQ ID NO: 4671 - protein, 121 aa, Homo sapiens; identical to SEQ ID NO: 4659
  Payload ID: 1026;
  Gene Symbol: ANAPC15;
  Gene Name: anaphase promoting complex subunit 15;
  Uniprot ID:  P60006;
  ENSP ID: ENSP00000443911

SEQ ID NO: 4672 - protein, 110 aa, Homo sapiens
  Payload ID: 1026;
  Gene Symbol: ANAPC15;
  Gene Name: anaphase promoting complex subunit 15;
  ENSP ID: ENSP00000445212
MSTLFPSLFPRVTETLWFNLDRPCVEETELQQQEQQHQAWLQSIAEKDNNLVPIGKPASEHYDDEEEEDDEDDEDSEEDSEDDEDMQDMDEMNDYNESPDDGEVNENGMG

SEQ ID NO: 4673 - protein, 121 aa, Homo sapiens; identical to SEQ ID NO: 4659
  Payload ID: 1026;
  Gene Symbol: ANAPC15;
  Gene Name: anaphase promoting complex subunit 15;
  Uniprot ID:  P60006;
  ENSP ID: ENSP00000446383

SEQ ID NO: 4674 - protein, 121 aa, Homo sapiens; identical to SEQ ID NO: 4659
  Payload ID: 1026;
  Gene Symbol: ANAPC15;
  Gene Name: anaphase promoting complex subunit 15;
  Uniprot ID:  P60006;
  ENSP ID: ENSP00000446412

SEQ ID NO: 4675 - protein, 110 aa, Homo sapiens
  Payload ID: 1027;
  Gene Symbol: ANAPC16;
  Gene Name: anaphase promoting complex subunit 16;
  Uniprot ID:  Q96DE5;
  ENSP ID: ENSP00000299381
MAASSSSSSAGGVSGSSVTGSGFSVSDLAPPRKALFTYPKGAGEMLEDGSERFLCESVFSYQVASTLKQVKHDQQVARMEKLAGLVEELEADEWRFKPIEQLLGFTPSSG

SEQ ID NO: 4676 - protein, 110 aa, Homo sapiens; identical to SEQ ID NO: 4675
  Payload ID: 1027;
  Gene Symbol: ANAPC16;
  Gene Name: anaphase promoting complex subunit 16;
  Uniprot ID:  Q96DE5;
  ENSP ID: ENSP00000477760

SEQ ID NO: 4677 - protein, 85 aa, Homo sapiens
  Payload ID: 1027;
  Gene Symbol: ANAPC16;
  Gene Name: anaphase promoting complex subunit 16;
  ENSP ID: ENSP00000478792
MAASSSSSSAGGVSGSSVTGSGFSVSDLAPPRKALFTYPKGAGEMLEDQQVARMEKLAGLVEELEADEWRFKPIEQLLGFTPSSG

SEQ ID NO: 4678 - protein, 822 aa, Homo sapiens
  Payload ID: 1028;
  Gene Symbol: ANAPC2;
  Gene Name: anaphase promoting complex subunit 2;
  Uniprot ID:  Q9UJX6;
  ENSP ID: ENSP00000314004
MAAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 4679 - protein, 808 aa, Homo sapiens
  Payload ID: 1029;
  Gene Symbol: ANAPC4;
  Gene Name: anaphase promoting complex subunit 4;
  Uniprot ID:  Q9UJX5;
  ENSP ID: ENSP00000318775
MLRFPTCFPSFRVVGEKQLPQEIIFLVWSPKRDLIALANTAGEVLLHRLASFHRVWSFPPNENTGKEVTCLAWRPDGKLLAFALADTKKIVLCDVEKPESLHSFSVEAPVSCMHWMEVTVESSVLTSFYNAEDESNLLLPKLPTLPKNYSNTSKIFSEENSDEIIKLLGDVRLNILVLGGSSGFIELYAYGMFKIARVTGIAGTCLALCLSSDLKSLSVVTEVSTNGASEVSYFQLETNLLYSFLPEVTRMARKFTHISALLQYINLSLTCMCEAWEEILMQMDSRLTKFVQEKNTTTSVQDEFMHLLLWGKASAELQTLLMNQLTVKGLKKLGQSIESSYSSIQKLVISHLQSGSESLLYHLSELKGMASWKQKYEPLGLDAAGIEEAITAVGSFILKANELLQVIDSSMKNFKAFFRWLYVAMLRMTEDHVLPELNKMTQKDITFVAEFLTEHFNEAPDLYNRKGKYFNVERVGQYLKDEDDDLVSPPNTEGNQWYDFLQNSSHLKESPLLFPYYPRKSLHFVKRRMENIIDQCLQKPADVIGKSMNQAICIPLYRDTRSEDSTRRLFKFPFLWNNKTSNLHYLLFTILEDSLYKMCILRRHTDISQSVSNGLIAIKFGSFTYATTEKVRRSIYSCLDAQFYDDETVTVVLKDTVGREGRDRLLVQLPLSLVYNSEDSAEYQFTGTYSTRLDEQCSAIPTRTMHFEKHWRLLESMKAQYVAGNGFRKVSCVLSSNLRHVRVFEMDIDDEWELDESSDEEEEASNKPVKIKEEVLSESEAENQQAGAAALAPEIVIKVEKLDPELDS

SEQ ID NO: 4680 - protein, 162 aa, Homo sapiens
  Payload ID: 1029;
  Gene Symbol: ANAPC4;
  Gene Name: anaphase promoting complex subunit 4;
  ENSP ID: ENSP00000421840
MLRFPTCFPSFRVVGEKQLPQEIIFLVWSPKRDLIALANTAGEVLLHRLASFHRVWSFPPNENTGKEVTCLAWRPDGKLLAFALADTKKIVLCDVEKPESLHSFSVEAPVSCMHWMEVTVESSVLTSFYNAEDESNLLLPKLPTLPKNYSNTSKIFSEENSD

SEQ ID NO: 4681 - protein, 83 aa, Homo sapiens
  Payload ID: 1029;
  Gene Symbol: ANAPC4;
  Gene Name: anaphase promoting complex subunit 4;
  ENSP ID: ENSP00000426512
MLRFPTCFPSFRVVGEKQLPQEIIFLVWSPKRDLIALANTAGEVLLHRLASFHRVWSFPPNENTGKEFWPLLLLIPRKLFCVM

SEQ ID NO: 4682 - protein, 809 aa, Homo sapiens
  Payload ID: 1029;
  Gene Symbol: ANAPC4;
  Gene Name: anaphase promoting complex subunit 4;
  Uniprot ID:  Q9UJX5;
  ENSP ID: ENSP00000426654
MLRFPTCFPSFRVVGEKQLPQEIIFLVWSPKRDLIALANTAGEVLLHRLASFHRVWSFPPNENTGKEVTCLAWRPDGKLLAFALADTKKIVLCDVEKPESLHSFSVEAPVSCMHWMEVTVESSVLTSFYNAEDESNLLLPKLPTLPKNYSNTSKIFSEENSDEIIKLLGDVRLNILVLGGSSGFIELYAYGMFKIARVTGIAGTCLALCLSSDLKSLSVVTEVSTNGASEVSYFQLETNLLYSFLPEVTRMARKFTHISALLQYINLSLTCMCEAWEEILMQMDSRLTKFVQEKNTTTSVQDEFMHLLLWGKASAELQTLLMNQLTVKGLKKLGQSIESSYSSIQKLVISHLQSGSESLLYHLSELKGMASWKQKYEPLGLDAAGIEEAITAVGSFILKANELLQVIDSSMKNFKAFFRWLYVAMLRMTEDHVLPELNKVMTQKDITFVAEFLTEHFNEAPDLYNRKGKYFNVERVGQYLKDEDDDLVSPPNTEGNQWYDFLQNSSHLKESPLLFPYYPRKSLHFVKRRMENIIDQCLQKPADVIGKSMNQAICIPLYRDTRSEDSTRRLFKFPFLWNNKTSNLHYLLFTILEDSLYKMCILRRHTDISQSVSNGLIAIKFGSFTYATTEKVRRSIYSCLDAQFYDDETVTVVLKDTVGREGRDRLLVQLPLSLVYNSEDSAEYQFTGTYSTRLDEQCSAIPTRTMHFEKHWRLLESMKAQYVAGNGFRKVSCVLSSNLRHVRVFEMDIDDEWELDESSDEEEEASNKPVKIKEEVLSESEAENQQAGAAALAPEIVIKVEKLDPELDS

SEQ ID NO: 4683 - protein, 755 aa, Homo sapiens
  Payload ID: 1030;
  Gene Symbol: ANAPC5;
  Gene Name: anaphase promoting complex subunit 5;
  Uniprot ID:  Q9UJX4;
  ENSP ID: ENSP00000261819
MASVHESLYFNPMMTNGVVHANVFGIKDWVTPYKIAVLVLLNEMSRTGEGAVSLMERRRLNQLLLPLLQGPDITLSKLYKLIEESCPQLANSVQIRIKLMAEGELKDMEQFFDDLSDSFSGTEPEVHKTSVVGLFLRHMILAYSKLSFSQVFKLYTALQQYFQNGEKKTVEDADMELTSRDEGERKMEKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 4684 - protein, 643 aa, Homo sapiens
  Payload ID: 1030;
  Gene Symbol: ANAPC5;
  Gene Name: anaphase promoting complex subunit 5;
  Uniprot ID:  Q9UJX4;
  ENSP ID: ENSP00000415061
MAEGELKDMEQFFDDLSDSFSGTEPEVHKTSVVGLFLRHMILAYSKLSFSQVFKLYTALQQYFQNGEKKTVEDADMELTSRDEGERKMEKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 4685 - protein, 396 aa, Homo sapiens
  Payload ID: 1030;
  Gene Symbol: ANAPC5;
  Gene Name: anaphase promoting complex subunit 5;
  ENSP ID: ENSP00000437857
  MOD_RES (1)..(1): Any amino acid
XASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVIRAVLAIFLPYHRAAHAPAGSGPLQGVPVTVLGL

SEQ ID NO: 4686 - protein, 421 aa, Homo sapiens
  Payload ID: 1030;
  Gene Symbol: ANAPC5;
  Gene Name: anaphase promoting complex subunit 5;
  ENSP ID: ENSP00000438754
MIYFDDFSCQSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 4687 - protein, 742 aa, Homo sapiens
  Payload ID: 1030;
  Gene Symbol: ANAPC5;
  Gene Name: anaphase promoting complex subunit 5;
  ENSP ID: ENSP00000439875
MASVHESLYFNPMMTNGVVHANVFGIKDWVTPYKIAVLVLLNEMSRTGEGAVSLMERRRLNQLLLPLLQGPDITLSKLYKLIEESCPQLANSVQIRIKLMAEGELKDMEQFFDDLSDSFSGTEPEVHKTSVVGLFLRHMILAYSKLSFSQVFKLYTALQQYFQNGEKKTVEDADMELTSRDEGERKMEKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 4688 - protein, 217 aa, Homo sapiens
  Payload ID: 1030;
  Gene Symbol: ANAPC5;
  Gene Name: anaphase promoting complex subunit 5;
  ENSP ID: ENSP00000440800
MAEGELKDMEQFFDDLSDSFSGTEPEVHKTSVVGLFLRHMILAYSKLSFSQVFKLYTALQQYFQNGEKKTVEDADMELTSRDEGERKMEKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGH

SEQ ID NO: 4689 - protein, 44 aa, Homo sapiens
  Payload ID: 1030;
  Gene Symbol: ANAPC5;
  Gene Name: anaphase promoting complex subunit 5;
  ENSP ID: ENSP00000441508
MAEGELKDMEQFFDDLSDSFSGTEPEVHKTSVVGLFLRHMILAY

SEQ ID NO: 4690 - protein, 216 aa, Homo sapiens
  Payload ID: 1030;
  Gene Symbol: ANAPC5;
  Gene Name: anaphase promoting complex subunit 5;
  ENSP ID: ENSP00000445191
MASVHESLYFNPMMTNGVVHANVFGIKDWVTPYKIAVLVLLNEMSRTGEGAVSLMERRRLNQLLLPLLQRRDFAMLPRLAGNSWTQAILPSGLPEYWDYRSEPLRPAVMCYFILQTQGPDITLSKLYKLIEESCPQLANSVQIRIKLMAEGELKDMEQFFDDLSDSFSGTEPEVHKTSVVGLFLRHMILAYSKLSFSQVFKLYTALQQYFQNGEKK

SEQ ID NO: 4691 - protein, 599 aa, Homo sapiens
  Payload ID: 1031;
  Gene Symbol: ANAPC7;
  Gene Name: anaphase promoting complex subunit 7;
  Uniprot ID:  Q9UJX3;
  ENSP ID: ENSP00000394394
MDPGDAAILESSLRILYRLFESVLPPLPAALQSRMNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKYKMAECYTMLKQDKDAIAILDGIPSRQRTPKINMMLANLYKKAGQERPSVTSYKEVLRQCPLALDAILGLLSLSVKGAEVASMTMNVIQTVPNLDWLSVWIKAYAFVHTGDNSRAISTICSLEKKSLLRDNVDLLGSLADLYFRAGDNKNSVLKFEQAQMLDPYLIKGMDVYGYLLAREGRLEDVENLGCRLFNISDQHAEPWVVSGCHSFYSKRYSRALYLGAKAIQLNSNSVQALLLKGAALRNMGRVQEAIIHFREAIRLAPCRLDCYEGLIECYLASNSIREAMVMANNVYKTLGANAQTLTLLATVCLEDPVTQEKAKTLLDKALTQRPDYIKAVVKKAELLSREQKYEDGIALLRNALANQSDCVLHRILGDFLVAVNEYQEAMDQYSIALSLDPNDQKSLEGMQKMEKEESPTDATQEEDVDDMEGSGEEGDLEGSDSEAAQWADQEQWFGMQ

SEQ ID NO: 4692 - protein, 537 aa, Homo sapiens
  Payload ID: 1031;
  Gene Symbol: ANAPC7;
  Gene Name: anaphase promoting complex subunit 7;
  Uniprot ID:  Q9UJX3;
  ENSP ID: ENSP00000402314
MDPGDAAILESSLRILYRLFESVLPPLPAALQSRMNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKYKMAECYTMLKQDKDAIAILDGIPSRQRTPKINMMLANLYKKAGQERPSVTSYKEVLRQCPLALDAILGLLSLSVKGAEVASMTMNVIQTVPNLDWLSVWIKAYAFVHTGDNSRAISTICSLEKKSLLRDNVDLLGSLADLYFRAGDNKNSVLKFEQAQMLDPYLIKGMDVYGYLLAREGRLEDVENLGCRLFNISDQHAEPWVVSGCHSFYSKRYSRALYLGAKAIQLNSNSVQALLLKGAALRNMGRVQEAIIHFREAIRLAPCRLDCYEGLIECYLASNSIREAMVMANNVYKTLGANAQTLTLLATVCLEDPVTQEKAKTLLDKALTQRPDYIKAVVKKAELLSREQKYEDGIALLRNALANQSDCVLHRILGDFLVAVNEYQEAMDQYSIALR

SEQ ID NO: 4693 - protein, 149 aa, Homo sapiens
  Payload ID: 1031;
  Gene Symbol: ANAPC7;
  Gene Name: anaphase promoting complex subunit 7;
  ENSP ID: ENSP00000450293
  MOD_RES (1)..(1): Any amino acid
XLLKGAALRNMGRVQEAIIHFREAIRLAPCRLDCYEGREQKYEDGIALLRNALANQSDCVLHRILGDFLVAVNEYQEAMDQYSIALSLDPNDQKSLEGMQKMEKEESPTDATQEEDVDDMEGSGEEGDLEGSDSEAAQWADQEQWFGMQ

SEQ ID NO: 4694 - protein, 54 aa, Homo sapiens
  Payload ID: 1031;
  Gene Symbol: ANAPC7;
  Gene Name: anaphase promoting complex subunit 7;
  ENSP ID: ENSP00000450405
  MOD_RES (1)..(1): Any amino acid
XVLPPLPAALQSRMNVIDHVRDMAAAGLHSNVRLLSSLLLTMSNNNPVFHLKLK

SEQ ID NO: 4695 - protein, 1620 aa, Homo sapiens
  Payload ID: 1032;
  Gene Symbol: ALK;
  Gene Name: anaplastic lymphoma receptor tyr kinase;
  Uniprot ID:  Q9UM73;
  ENSP ID: ENSP00000373700
MGAIGLLWLLPLLLSTAAVGSGMGTGQRAGSPAAGPPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 4696 - protein, 152 aa, Homo sapiens
  Payload ID: 1032;
  Gene Symbol: ALK;
  Gene Name: anaplastic lymphoma receptor tyr kinase;
  ENSP ID: ENSP00000387488
SSISDLKEVPRKNITLIRGLGHGAFGEVYEGQVSGMPNDPSPLQVAVKTLPEVCSEQDELDFLMEALIISLSWKQLFCFTFCLRPSWEKSTMNSSTQSTHQYLRKTLSCPLRHFLTQVPEQHPHSSSHSPANGTPVEPAVVLPTCSPARFWV

SEQ ID NO: 4697 - protein, 580 aa, Homo sapiens
  Payload ID: 1032;
  Gene Symbol: ALK;
  Gene Name: anaplastic lymphoma receptor tyr kinase;
  ENSP ID: ENSP00000414027
MVTTCSAIYTFQFIRSSVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 4698 - protein, 1243 aa, Homo sapiens
  Payload ID: 1032;
  Gene Symbol: ALK;
  Gene Name: anaplastic lymphoma receptor tyr kinase;
  ENSP ID: ENSP00000482733
MPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 4699 - protein, 410 aa, Homo sapiens
  Payload ID: 1033;
  Gene Symbol: AUP1;
  Gene Name: ancient ubiquitous prt 1;
  Uniprot ID:  Q9Y679;
  ENSP ID: ENSP00000366748
MELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKFPSSGPVTPQPTALTFAKSSWARQESLQERKQALYEYARRRFTERRAQEAD

SEQ ID NO: 4700 - protein, 373 aa, Homo sapiens
  Payload ID: 1033;
  Gene Symbol: AUP1;
  Gene Name: ancient ubiquitous prt 1;
  Uniprot ID:  Q9Y679;
  ENSP ID: ENSP00000403430
MELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKAFDACLMMMTPQAL

SEQ ID NO: 4701 - protein, 920 aa, Homo sapiens
  Payload ID: 1034;
  Gene Symbol: AR;
  Gene Name: androgen receptor;
  ENSP ID: ENSP00000363822
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 4702 - protein, 388 aa, Homo sapiens
  Payload ID: 1034;
  Gene Symbol: AR;
  Gene Name: androgen receptor;
  Uniprot ID:  P10275;
  ENSP ID: ENSP00000379358
MILWLHSLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 4703 - protein, 734 aa, Homo sapiens
  Payload ID: 1034;
  Gene Symbol: AR;
  Gene Name: androgen receptor;
  ENSP ID: ENSP00000379359
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPDCERAASVHF

SEQ ID NO: 4704 - protein, 644 aa, Homo sapiens
  Payload ID: 1034;
  Gene Symbol: AR;
  Gene Name: androgen receptor;
  ENSP ID: ENSP00000421155
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGEKFRVGNCKHLKMTRP

SEQ ID NO: 4705 - protein, 600 aa, Homo sapiens
  Payload ID: 1034;
  Gene Symbol: AR;
  Gene Name: androgen receptor;
  ENSP ID: ENSP00000425199
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGFFRMNKLKES

SEQ ID NO: 4706 - protein, 572 aa, Homo sapiens
  Payload ID: 1034;
  Gene Symbol: AR;
  Gene Name: androgen receptor;
  ENSP ID: ENSP00000479013
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRNTRRKRLWKLIIRSINSCICSPRETEVPVRQQK

SEQ ID NO: 4707 - protein, 642 aa, Homo sapiens
  Payload ID: 1034;
  Gene Symbol: AR;
  Gene Name: androgen receptor;
  ENSP ID: ENSP00000482407
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGFFRMNKLKESSDTNPKPYCMAAPMGLTENNRNRKKSYRETNLKAVSWPLNHT

SEQ ID NO: 4708 - protein, 737 aa, Homo sapiens
  Payload ID: 1034;
  Gene Symbol: AR;
  Gene Name: androgen receptor;
  ENSP ID: ENSP00000484033
MQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIKANLFARIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 4709 - protein, 248 aa, Homo sapiens
  Payload ID: 1035;
  Gene Symbol: ADTRP;
  Gene Name: androgen-dependent TFPI-regulating prt;
  Uniprot ID:  Q96IZ2;
  ENSP ID: ENSP00000229583
MTKTSTCIYHFLVLSWYTFLNYYISQEGKDEVKPKILANGARWKYMTLLNLLKNRTAGFDIYQPGSFRQLLQTIFYGVTCLDDVLKRTKGGKDIKFLTAFRDLLFTTLAFPVSTFVFLAFWILFLYNRDLIYPKVLDTVIPVWLNHAMHTFIFPITLAEVVLRPHSYPSKKTGLTLLAAASIAYISRILWLYFETGTWVYPVFAKLSLLGLAAFFSLSYVFIASIYLLGEKLNHWKWGDMRQPRKKRK

SEQ ID NO: 4710 - protein, 168 aa, Homo sapiens
  Payload ID: 1035;
  Gene Symbol: ADTRP;
  Gene Name: androgen-dependent TFPI-regulating prt;
  ENSP ID: ENSP00000368726
MTKTSTCIYHFLVLSWYTFLNYYISQEGKDEVKPKILANGARWKYMTLLNLLLQTIFYGVTCLDDVLKRTKGGKDIKFLTAFRDLLFTTLAFPVSTFVFLAFWILFLYNRDLIYPKVLDTVIPVWLNHAMHTFIFPITLAEVVLRPHSYPSKKTGLTLLAAASIAYIS

SEQ ID NO: 4711 - protein, 230 aa, Homo sapiens
  Payload ID: 1035;
  Gene Symbol: ADTRP;
  Gene Name: androgen-dependent TFPI-regulating prt;
  Uniprot ID:  Q96IZ2;
  ENSP ID: ENSP00000404416
MTKTSTCIYHFLVLSWYTFLNYYISQEGKDEVKPKILANGARWKYMTLLNLLLQTIFYGVTCLDDVLKRTKGGKDIKFLTAFRDLLFTTLAFPVSTFVFLAFWILFLYNRDLIYPKVLDTVIPVWLNHAMHTFIFPITLAEVVLRPHSYPSKKTGLTLLAAASIAYISRILWLYFETGTWVYPVFAKLSLLGLAAFFSLSYVFIASIYLLGEKLNHWKWGDMRQPRKKRK

SEQ ID NO: 4712 - protein, 86 aa, Homo sapiens
  Payload ID: 1035;
  Gene Symbol: ADTRP;
  Gene Name: androgen-dependent TFPI-regulating prt;
  ENSP ID: ENSP00000420956
MTKTSTCIYHFLVLSWYTFLNYYISQEGKDEVKPKILANGARWKYMTLLNLSSSRTGLLGLTSTSQEALGSSCRPFSTGSPAWMMC

SEQ ID NO: 4713 - protein, 168 aa, Homo sapiens; identical to SEQ ID NO: 4710
  Payload ID: 1035;
  Gene Symbol: ADTRP;
  Gene Name: androgen-dependent TFPI-regulating prt;
  ENSP ID: ENSP00000422927

SEQ ID NO: 4714 - protein, 120 aa, Homo sapiens
  Payload ID: 1035;
  Gene Symbol: ADTRP;
  Gene Name: androgen-dependent TFPI-regulating prt;
  ENSP ID: ENSP00000424680
  MOD_RES (1)..(1): Any amino acid
XLIYPKVLDTVIPVWLNHAMHTFIFPITLAEVVLRPHSYPSKKTGLTLLAAASIAYISRILWLYFETGTWVYPVFAKLSLLGLAAFFSLSYVFIASIYLLGEKLNHWKWGDMRQPRKKRK

SEQ ID NO: 4715 - protein, 116 aa, Homo sapiens
  Payload ID: 1035;
  Gene Symbol: ADTRP;
  Gene Name: androgen-dependent TFPI-regulating prt;
  ENSP ID: ENSP00000426507
AEVVLRPHSYPSKKTGLTLLAAASIAYISRILWLYFETGTWVYPVFAKLSLLGLAAFFSLSYVFIASIYLLGEKLNHWKWVSVQILQRWRLESVGICFQWPDWKSPAKHQLVKNIR

SEQ ID NO: 4716 - protein, 245 aa, Homo sapiens
  Payload ID: 1036;
  Gene Symbol: AIG1;
  Gene Name: androgen-induced 1;
  Uniprot ID:  Q9NVV5;
  ENSP ID: ENSP00000275235
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKKPPSWQDMKIKFMYLGPSS

SEQ ID NO: 4717 - protein, 223 aa, Homo sapiens
  Payload ID: 1036;
  Gene Symbol: AIG1;
  Gene Name: androgen-induced 1;
  ENSP ID: ENSP00000340090
MAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMGVPFPGTIGPGARIIFFGSTTILMNFLYLLGEVLNNYIWDTEKYGRRERKA

SEQ ID NO: 4718 - protein, 238 aa, Homo sapiens
  Payload ID: 1036;
  Gene Symbol: AIG1;
  Gene Name: androgen-induced 1;
  Uniprot ID:  Q9NVV5;
  ENSP ID: ENSP00000350509
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 4719 - protein, 47 aa, Homo sapiens
  Payload ID: 1036;
  Gene Symbol: AIG1;
  Gene Name: androgen-induced 1;
  ENSP ID: ENSP00000356568
MALVPCQVLRMAILLSYCSILCNYKAIEMPSHQTYGGSWKFLTFIDL

SEQ ID NO: 4720 - protein, 192 aa, Homo sapiens
  Payload ID: 1036;
  Gene Symbol: AIG1;
  Gene Name: androgen-induced 1;
  ENSP ID: ENSP00000356573
MTKVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGAR

SEQ ID NO: 4721 - protein, 123 aa, Homo sapiens
  Payload ID: 1036;
  Gene Symbol: AIG1;
  Gene Name: androgen-induced 1;
  ENSP ID: ENSP00000405048
MALVPCQVLRMAILLSYCSILCNYKAIEMPSHQTYGGSWKFLTFIDLFVVAVFWIIYAYDREMIYPKLLDNFIPGWLNHGMHTTVLPFILIEMRTSHHQYPSRSSGLTAICTFSVGYILWVCW

SEQ ID NO: 4722 - protein, 138 aa, Homo sapiens
  Payload ID: 1036;
  Gene Symbol: AIG1;
  Gene Name: androgen-induced 1;
  ENSP ID: ENSP00000407817
MLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQK

SEQ ID NO: 4723 - protein, 137 aa, Homo sapiens
  Payload ID: 1036;
  Gene Symbol: AIG1;
  Gene Name: androgen-induced 1;
  Uniprot ID:  Q9NVV5;
  ENSP ID: ENSP00000473952
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHFKA

SEQ ID NO: 4724 - protein, 134 aa, Homo sapiens
  Payload ID: 1036;
  Gene Symbol: AIG1;
  Gene Name: androgen-induced 1;
  Uniprot ID:  Q9NVV5;
  ENSP ID: ENSP00000485875
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGML

SEQ ID NO: 4725 - protein, 259 aa, Homo sapiens
  Payload ID: 1037;
  Gene Symbol: ADGB;
  Gene Name: androglobin;
  ENSP ID: ENSP00000323839
MHEHATPVTSAYGERHEELINLGSPDSHTISEGQKSSVTSKTTRKGKEKSSEKEKTAKEKQAPRFEPQISTVHPQQEDPNKPYWILRLVTEHNESELFEVKKDTERADEIRAMKQAWETTEPGRAIKASQARLHYLSGFIKKTSDAESPPISESQTKPKEEVETAARGVKEPNSKNSAGSESKEMTQTGSGSAVWKKWQLTKGLRDVAKSTSSESGGVSSPGKEEREQSTRKENIQTGPRTRSPTILETSPRLIRKALE

SEQ ID NO: 4726 - protein, 112 aa, Homo sapiens
  Payload ID: 1037;
  Gene Symbol: ADGB;
  Gene Name: androglobin;
  ENSP ID: ENSP00000356459
DELNQQQAMQKAEEIHQFRQHRTRVLSIRNIDQEERLKLKDEVLDMYKEMQDSLDEARQKIFDIREEYRNKLLEAEHLKLEALSAQEAAMKLETEKMTPAPDTQKKKKGKKK

SEQ ID NO: 4727 - protein, 625 aa, Homo sapiens
  Payload ID: 1037;
  Gene Symbol: ADGB;
  Gene Name: androglobin;
  ENSP ID: ENSP00000356460
VADTLQKVWAVLEMNLEQYAVSLLRLMFKSKCKSLESYPCYQDEETKIAFADYTVTYQEQPPNSWFIVFRETFLVHQDMILVPKVYTTLPICILHIVNNDTMEQVPKVFQKVVPYLYTKNKKGYTFVAEAFTGDTYVAASRWKLRLIGSSAPLPCLSRDSPCNSFAIKEIRDYYIPNDKKILFRYSVKVLTPQPATIQVRTSKPDAFIKLQVLENEETMVSSTGKGQAIIPAFHFLKSEKGLSSQSYGERHEELINLGSPDSHTISEGQKSSVTSKTTRKGKEKSSEKEKTAKEKQAPRFEPQISTVHPQQEDPNKPYWILRLVTEHNESELFEVKKDTERADEIRAMKQAWETTEPGRAIKASQARLHYLSGFIKKTSDAESPPISESQTKPKEEVETAARGVKEPNSKNSAGSESKEMTQTGSGSAVWKKWQLTKGLRDVAKSTSSESGGVSSPGKEEREQSTRKENIQTGPRTRSPTILETSPRLIRKALEFMDLSQYVRKTDTDPLLQTDELNQQQAMQKAEEIHQFRQHRTRVLSIRNIDQEERLKLKDEVLDMYKEMQDSLDEARQKIFDIREEYRNKLLEAEHLKLETLAAQEAAMKLETEKMTPAPDTQKKKKGKKK

SEQ ID NO: 4728 - protein, 1667 aa, Homo sapiens
  Payload ID: 1037;
  Gene Symbol: ADGB;
  Gene Name: androglobin;
  Uniprot ID:  Q8N7X0;
  ENSP ID: ENSP00000381036
MASKQTKKKEVHRINSAHGSDKSKDFYPFGSNVQSGSTEQKKGKFPLWPEWSEADINSEKWDAGKGAKEKDKTGKSPVFHFFEDPEGKIELPPSLKIYSWKRPQDILFSQTPVVVKNEITFDLFSANEHLLCSELMRWIISEIYAVWKIFNGGILSNYFKGTSGEPPLLPWKPWEHIYSLCKAVKGHMPLFNSYGKYVVKLYWMGCWRKITIDDFLPFDEDNNLLLPATTYEFELWPMLLSKAIIKLANIDIHVADRRELGEFTVIHALTGWLPEVISLHPGYMDKVWELLKEILPEFKLSDEASSESKIAVLDSKLKEPGKEGKEGKEIKDGKEVKDVKEFKPESSLTTLKAPEKSDKVPKEKADARDIGKKRSKDGEKEKFKFSLHGSRPSSEVQYSVQSLSDCSSAIQTSHMVVYATFTPLYLFENKIFSLEKMADSAEKLREYGLSHICSHPVLVTRSRSCPLVAPPKPPPLPPWKLIRQKKETVITDEAQELIVKKPERFLEISSPFLNYRMTPFTIPTEMHFVRSLIKKGIPPGSDLPSVSETDETATHSQTDLSQITKATSQGNTASQVILGKGTDEQTDFGLGDAHQSDGLNLEREIVSQTTATQEKSQEELPTTNNSVSKEIWLDFEDFCVCFQNIYIFHKPSSYCLNFQKSEFKFSEERVSYYLFVDSLKPIELLVCFSALVRWGEYGALTKDSPPIEPGLLTAETFSWKSLKPGSLVLKIHTYATKATVVRLPVGRHMLLFNAYSPVGHSIHICSMVSFVIGDEHVVLPNFEPESCRFTEQSLLIMKAIGNVIANFKDKGKLSAALKDLQTAHYPVPFHDKELTAQHFRVFHLSLWRLMKKVQITKPPPNFKFAFRAMVLDLELLNSSLEEVSLVEWLDVKYCMPTSDKEYSAEEVAAAIKIQAMWRGTYVRLLMKARIPDTKENISVADTLQKVWAVLEMNLEQYAVSLLRLMFKSKCKSLESYPCYQDEETKIAFADYTVTYQEQPPNSWFIVFRETFLVHQDMILVPKVYTTLPICILHIVNNDTMEQVPKVFQKVVPYLYTKNKKGYTFVAEAFTGDTYVAASRWKLRLIGSSAPLPCLSRDSPCNSFAIKEIRDYYIPNDKKILFRYSVKVLTPQPATIQVRTSKPDAFIKLQVLENEETMVSSTGKGQAIIPAFHFLKSEKGLSSQSSKHILSFHSASKKEQEVYVKKKAAQGIQKSPKGRAVSAIQDIGLPLVEEETTSTPTREDSSSTPLQNYKYIIQCSVLYNSWPLTESQLTFVQALKDLKKSNTKAYGERHEELINLGSPDSHTISEGQKSSVTSKTTRKGKEKSSEKEKTAKEKQAPRFEPQISTVHPQQEDPNKPYWILRLVTEHNESELFEVKKDTERADEIRAMKQAWETTEPGRAIKASQARLHYLSGFIKKTSDAESPPISESQTKPKEEVETAARGVKEPNSKNSAGSESKEMTQTGSGSAVWKKWQLTKGLRDVAKSTSSESGGVSSPGKEEREQSTRKENIQTGPRTRSPTILETSPRLIRKALEFMDLSQYVRKTDTDPLLQTDELNQQQAMQKAEEIHQFRQHRTRVLSIRNIDQEERLKLKDEVLDMYKEMQDSLDEARQKIFDIREEYRNKLLEAEHLKLETLAAQEAAMKLETEKMTPAPDTQKKKKGKKK

SEQ ID NO: 4729 - protein, 141 aa, Homo sapiens
  Payload ID: 1037;
  Gene Symbol: ADGB;
  Gene Name: androglobin;
  ENSP ID: ENSP00000427779
MHEHATPVTSAYGERHEELINLGSPDSHTISEGQKSSVTSKTTRKGKEKSSEKEKTAKEKQAPRFEPQASQARLHYLSGFIKKTSDAESPPISESQTKPKEEVETAARGVKEPNSKNSAGSESKEMTQTGSGSAVWKKWQL

SEQ ID NO: 4730 - protein, 178 aa, Homo sapiens
  Payload ID: 1037;
  Gene Symbol: ADGB;
  Gene Name: androglobin;
  ENSP ID: ENSP00000428035
MASKQTKKKEVHRINSAHGSDKSKDNVQSGSTEQKKGKFPLWPEWSEADINSEKWDAGKGAKEKDKTGKSPVFHFFEDPEGKIELPPSLKIYSWKRPQDILFSQTPVVVKNEITFDLFSANEHLLCSELMRWIISEIYAVWKIFNGGILSNYFKGTSGEPPLLPWKPWEHIYSLCKAV

SEQ ID NO: 4731 - protein, 714 aa, Homo sapiens
  Payload ID: 1037;
  Gene Symbol: ADGB;
  Gene Name: androglobin;
  ENSP ID: ENSP00000429315
  MOD_RES (1)..(1): Any amino acid
XTDEQTDFGLGDAHQSDGLNLEREIVSQTTATQEKSQEELPTTNNSVSKEIWLDFEDFCVCFQNIYIFHKPSSYCLNFQKSEFKFSEERVSYYLFVDSLKPIELLVCFSALVRWGEYGALTKDSPPIEPGLLTAETFSWKSLKPGSLVLKIHTYATKATVVRLPVGRHMLLFNAYSPVGHSIHICSMVSFVIGDEHVVLPNFEPESCRFTEQSLLIMKAIGNVIANFKDKGKLSAALKDLQTAHYPVPFHDKELTAQHFRVFHLSLWRLMKKVQITKPPPNFKFAFRAMVLDLELLNSSLEEVSLVEWLDVKYCMPTSDKEYSAEEVAAAIKIQAMWRGTYVRLLMKARIPDTKENISVADTLQKVWAVLEMNLEQYAVSLLRLMFKSKCKSLESYPCYQDEETKIAFADYTVTYQEQPPNSWFIVFRETFLVHQDMILVPKVYTTLPICILHIVNNDTMEQVPKVFQKVVPYLYTKNKKGYTFVAEAFTGDTYVAASRWKLRLIGSSAPLPCLSRDSPCNSFAIKEIRDYYIPNDKKILFRYSVKVLTPQPATIQVRTSKPDAFIKLQVLENEETMVSSTGKGQAIIPAFHFLKSEKGLSSQSYGERHEELINLGSPDSHTISEGQKSSVTSKTTRKGKEKSSEKEKTAKEKQAPRFEPQISTVHPQQEDPNKPYWILRLLRLVCITLAGSLRKHLMLRVRLYLKAKLNQKKK

SEQ ID NO: 4732 - protein, 35 aa, Homo sapiens
  Payload ID: 1037;
  Gene Symbol: ADGB;
  Gene Name: androglobin;
  ENSP ID: ENSP00000429365
MASKQTKKKEVHRINSAHGSDKSKESKAEDALQNQ

SEQ ID NO: 4733 - protein, 220 aa, Homo sapiens
  Payload ID: 1037;
  Gene Symbol: ADGB;
  Gene Name: androglobin;
  ENSP ID: ENSP00000430244
MASKQTKKKEVHRINSAHGSDKSKDFYPFGSNVQSGSTEQKKGKFPLWPEWSEADINSEKWDAGKGAKEKDKTGKSPVFHFFEDPEGKIELPPSLKIYSWKRPQDILFSQTPVVVKNEITFDLFSANEHLLCSELMRWIISEIYAVWKIFNGGILSNYFKGTSGEPPLLPWKPWEHIYSLCKAVKGHMPLFNSYGKYVVKLYWMPGIYGQSLGAPERNIA

SEQ ID NO: 4734 - protein, 71 aa, Homo sapiens
  Payload ID: 1037;
  Gene Symbol: ADGB;
  Gene Name: androglobin;
  ENSP ID: ENSP00000430834
PLFNSYGKYVVKLYWMGCWRKITIDDFLPFDEDNNLLLPATTYEFELWPMLLSKAIIKLANIEYVMTLSLT

SEQ ID NO: 4735 - protein, 670 aa, Homo sapiens
  Payload ID: 1038;
  Gene Symbol: ANGEL1;
  Gene Name: angel homolog 1 (Drosophila);
  Uniprot ID:  Q9UNK9;
  ENSP ID: ENSP00000251089
MIASCLCYLLLPATRLFRALSDAFFTCRKNVLLANSSSPQVEGDFAMAPRGPEQEECEGLLQQWREEGLSQVLSTASEGPLIDKGLAQSSLALLMDNPGEENAASEDRWSSRQLSDLRAAENLDEPFPEMLGEEPLLEVEGVEGSMWAAIPMQSEPQYADCAALPVGALATEQWEEDPAVLAWSIAPEPVPQEEASIWPFEGLGQLQPPAVEIPYHEILWREWEDFSTQPDAQGLKAGDGPQFQFTLMSYNILAQDLMQQSSELYLHCHPDILNWNYRFVNLMQEFQHWDPDILCLQEVQEDHYWEQLEPSLRMMGFTCFYKRRTGCKTDGCAVCYKPTRFRLLCASPVEYFRPGLELLNRDNVGLVLLLQPLVPEGLGQVSVAPLCVANTHILYNPRRGDVKLAQMAILLAEVDKVARLSDGSHCPIILCGDLNSVPDSPLYNFIRDGELQYHGMPAWKVSGQEDFSHQLYQRKLQAPLWPSSLGITDCCQYVTSCHPKRSERRKYGRDFLLRFRFCSIACQRPVGLVLMEGVTDTKPERPAGWAESVLEEDASELEPAFSRTVGTIQHCLHLTSVYTHFLPQRGRPEVTTMPLGLGMTVDYIFFSAESCENGNRTDHRLYRDGTLKLLGRLSLLSEEILWAANGLPNPFCSSDHLCLLASFGMEVTAP

SEQ ID NO: 4736 - protein, 235 aa, Homo sapiens
  Payload ID: 1038;
  Gene Symbol: ANGEL1;
  Gene Name: angel homolog 1 (Drosophila);
  ENSP ID: ENSP00000451534
MSQNMGCYFLFLSWFPYSHPSFSTQVSGQEDFSHQLYQRKLQAPLWPSSLGITDCCQYVTSCHPKRSERRKYGRDFLLRFRFCSIACQRPVGLVLMEGVTDTKPERPAGWAESVLEEDASELEPAFSRTVGTIQHCLHLTSVYTHFLPQRGRPEVTTMPLGLGMTVDYIFFSAESCENGNRTDHRLYRDGTLKLLGRLSLLSEEILWAANGLPNPFCSSDHLCLLASFGMEVTAP

SEQ ID NO: 4737 - protein, 129 aa, Homo sapiens
  Payload ID: 1038;
  Gene Symbol: ANGEL1;
  Gene Name: angel homolog 1 (Drosophila);
  ENSP ID: ENSP00000451568
MAPRGPEQEECEGLLQQWREEGLSQVLSTASEGPLIDKGLAQSSLALLMDNPGEENAASEDRWSSRQLSDLRAAENLDEPFPEMLGEEPLLEVEGVEGSMWAAIPMQSEPQYADCAALPVGALATEQWE

SEQ ID NO: 4738 - protein, 67 aa, Homo sapiens
  Payload ID: 1038;
  Gene Symbol: ANGEL1;
  Gene Name: angel homolog 1 (Drosophila);
  ENSP ID: ENSP00000452287
MEGVTDTKPERPAGWAESVLEEDASELEPAFSRTVGTIQHCLHLTSVYTHFLPQRGRPEVTTMPLGL

SEQ ID NO: 4739 - protein, 375 aa, Homo sapiens
  Payload ID: 1039;
  Gene Symbol: ANGEL2;
  Gene Name: angel homolog 2 (Drosophila);
  Uniprot ID:  Q5VTE6;
  ENSP ID: ENSP00000353696
MSYNILSQDLLEDNSHLYRHCRRPVLHWSFRFPNILKEIKHFDADVLCLQEVQEDHYGAEIRPSLESLGYHCEYKMRTGRKPDGCAICFKHSKFSLLSVNPVEFFRPDISLLDRDNVGLVLLLQPKIPYAACPAICVANTHLLYNPRRGDIKLTQLAMLLAEISSVAHQKDGSFCPIVMCGDFNSVPGSPLYSFIKEGKLNYEGLPIGKVSGQEQSSRGQRILSIPIWPPNLGISQNCVYEVQQVPKVEKTDSDLTQTQLKQTEVLVTAEKLSSNLQHHFSLSSVYSHYFPDTGIPEVTTCHSRSAITVDYIFYSAEKEDVAGHPGAEVALVGGLKLLARLSLLTEQDLWTVNGLPNENNSSDHLPLLAKFRLEL

SEQ ID NO: 4740 - protein, 544 aa, Homo sapiens
  Payload ID: 1039;
  Gene Symbol: ANGEL2;
  Gene Name: angel homolog 2 (Drosophila);
  Uniprot ID:  Q5VTE6;
  ENSP ID: ENSP00000355929
MEAWRCVRKGYGHCVVGRGRYPMFPHHSRSLGRDWTTPWENLQRCCWNRHISSCMRWPGHYSRAPYPYFSSRHFSLNWRPPCLFESRTQFQYCNWRPDNLSQTSLIHLSSYVMNAEGDEPSSKRRKHQGVIKRNWEYICSHDKEKTKILGDKNVDPKCEDSENKFDFSVMSYNILSQDLLEDNSHLYRHCRRPVLHWSFRFPNILKEIKHFDADVLCLQEVQEDHYGAEIRPSLESLGYHCEYKMRTGRKPDGCAICFKHSKFSLLSVNPVEFFRPDISLLDRDNVGLVLLLQPKIPYAACPAICVANTHLLYNPRRGDIKLTQLAMLLAEISSVAHQKDGSFCPIVMCGDFNSVPGSPLYSFIKEGKLNYEGLPIGKVSGQEQSSRGQRILSIPIWPPNLGISQNCVYEVQQVPKVEKTDSDLTQTQLKQTEVLVTAEKLSSNLQHHFSLSSVYSHYFPDTGIPEVTTCHSRSAITVDYIFYSAEKEDVAGHPGAEVALVGGLKLLARLSLLTEQDLWTVNGLPNENNSSDHLPLLAKFRLEL

SEQ ID NO: 4741 - protein, 375 aa, Homo sapiens; identical to SEQ ID NO: 4739
  Payload ID: 1039;
  Gene Symbol: ANGEL2;
  Gene Name: angel homolog 2 (Drosophila);
  Uniprot ID:  Q5VTE6;
  ENSP ID: ENSP00000438141

SEQ ID NO: 4742 - protein, 262 aa, Homo sapiens
  Payload ID: 1039;
  Gene Symbol: ANGEL2;
  Gene Name: angel homolog 2 (Drosophila);
  ENSP ID: ENSP00000484198
MFPHHSRSLGRDWTTPWENLQRCCWNRHISSCMRWPGHYSRAPYPYFSSRHFSLNWRPPCLFESRTQFQYCNWRPDNLSQTSLIHLSSYVMNAEGDEPSSKRRKHQGVIKRNWEYICSHDKEKTKILGDKNVDPKCEDSENKFDFSVMSYNILSQDLLEDNSHLYRHCRRPVLHWSFRFPNILKEIKHFDADVLCLQEVQEDHYGAEIRPSLESLGTMQLFFFFFFFETGSHSVAQLECSGTIMAHYSLNLLGSSNPLISAS

SEQ ID NO: 4743 - protein, 434 aa, Homo sapiens
  Payload ID: 1040;
  Gene Symbol: AAMP;
  Gene Name: angio-associated, migratory cell prt;
  Uniprot ID:  Q13685;
  ENSP ID: ENSP00000248450
MESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 4744 - protein, 200 aa, Homo sapiens
  Payload ID: 1040;
  Gene Symbol: AAMP;
  Gene Name: angio-associated, migratory cell prt;
  ENSP ID: ENSP00000393818
MEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQ

SEQ ID NO: 4745 - protein, 189 aa, Homo sapiens
  Payload ID: 1040;
  Gene Symbol: AAMP;
  Gene Name: angio-associated, migratory cell prt;
  ENSP ID: ENSP00000396295
  MOD_RES (1)..(1): Any amino acid
XIHVLKGIRGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 4746 - protein, 435 aa, Homo sapiens
  Payload ID: 1040;
  Gene Symbol: AAMP;
  Gene Name: angio-associated, migratory cell prt;
  ENSP ID: ENSP00000403343
MESESESGAAADTPPLETLSFHGDEEIIEVVELDPGPPDPADDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 4747 - protein, 415 aa, Homo sapiens
  Payload ID: 1040;
  Gene Symbol: AAMP;
  Gene Name: angio-associated, migratory cell prt;
  ENSP ID: ENSP00000416394
MLLSVPLTASRAPSSNPLPKADDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 4748 - protein, 714 aa, Homo sapiens
  Payload ID: 1041;
  Gene Symbol: AGGF1;
  Gene Name: angiogenic  factor with G patch and FHA domains 1;
  Uniprot ID:  Q8N302;
  ENSP ID: ENSP00000316109
MASEAPSPPRSPPPPTSPEPELAQLRRKVEKLERELRSCKRQVREIEKLLHHTERLYQNAESNNQELRTQVEELSKILQRGRNEDNKKSDVEVQTENHAPWSISDYFYQTYYNDVSLPNKVTELSDQQDQAIETSILNSKDHLQVENDAYPGTDRTENVKYRQVDHFASNSQEPASALATEDTSLEGSSLAESLRAAAEAAVSQTGFSYDENTGLYFDHSTGFYYDSENQLYYDPSTGIYYYCDVESGRYQFHSRVDLQPYPTSSTKQSKDKKLKKKRKDPDSSATNEEKDLNSEDQKAFSVEHTSCNEEENFANMKKKAKIGIHHKNSPPKVTVPTSGNTIESPLHENISNSTSFKDEKIMETDSEPEEGEITDSQTEDSYDEAITSEGNVTAEDSEDEDEDKIWPPCIRVIVIRSPVLQIGSLFIITAVNPATIGREKDMEHTLRIPEVGVSKFHAEIYFDHDLQSYVLVDQGSQNGTIVNGKQILQPKTKCDPYVLEHGDEVKIGETVLSFHIHPGSDTCDGCEPGQVRAHLRLDKKDESFVGPTLSKEEKELERRKELKKIRVKYGLQNTEYEDEKTLKNPKYKDRAGKRREQVGSEGTFQRDDAPASVHSEITDSNKGRKMLEKMGWKKGEGLGKDGGGMKTPIQLQLRRTHAGLGTGKPSSFEDVHLLQNKNKKNWDKARERFTENFPETKPQKDDPGTMPWVKGTLE

SEQ ID NO: 4749 - protein, 87 aa, Homo sapiens
  Payload ID: 1041;
  Gene Symbol: AGGF1;
  Gene Name: angiogenic  factor with G patch and FHA domains 1;
  ENSP ID: ENSP00000420874
  MOD_RES (1)..(1): Any amino acid
XFPAQLGSCWSSSGLWFSDCLSDAPPSVSVAGEGSFQESFPVCRPRTSGRGHPRSPCSLLAAPFGYKWKNSVKYSNVGEMKIIKSLM

SEQ ID NO: 4750 - protein, 176 aa, Homo sapiens
  Payload ID: 1041;
  Gene Symbol: AGGF1;
  Gene Name: angiogenic  factor with G patch and FHA domains 1;
  Uniprot ID:  Q8N302;
  ENSP ID: ENSP00000424733
MASEAPSPPRSPPPPTSPEPELAQLRRKVEKLERELRSCKRQVREIEKLLHHTERLYQNAESNNQELRTQVEELSKILQRGRNEDNKKSDVEVQTENHAPWSISDYFYQTYYNDVSLPNKVTELSDQQDQAIETSILNSKDHLQVENDAYPGTDRTENVKYRQVDHFASNSQVIKC

SEQ ID NO: 4751 - protein, 147 aa, Homo sapiens
  Payload ID: 1042;
  Gene Symbol: ANG;
  Gene Name: angiogenin, ribonuclease, RNase A family, 5;
  Uniprot ID:  P03950;
  ENSP ID: ENSP00000336762
MVMGLGVLLLVFVLGLGLTPPTLAQDNSRYTHFLTQHYDAKPQGRDDRYCESIMRRRGLTSPCKDINTFIHGNKRSIKAICENKNGNPHRENLRISKSSFQVTTCKLHGGSPWPPCQYRATAGFRNVVVACENGLPVHLDQSIFRRP

SEQ ID NO: 4752 - protein, 147 aa, Homo sapiens; identical to SEQ ID NO: 4751
  Payload ID: 1042;
  Gene Symbol: ANG;
  Gene Name: angiogenin, ribonuclease, RNase A family, 5;
  Uniprot ID:  P03950;
  ENSP ID: ENSP00000381077

SEQ ID NO: 4753 - protein, 675 aa, Homo sapiens
  Payload ID: 1043;
  Gene Symbol: AMOT;
  Gene Name: angiomotin;
  Uniprot ID:  Q4VCS5;
  ENSP ID: ENSP00000305557
MPRAQPSSASYQPVPADPFAIVSRAQQMVEILSDENRNLRQELEGCYEKVARLQKVETEIQRVSEAYENLVKSSSKREALEKAMRNKLEGEIRRMHDFNRDLRERLETANKQLAEKEYEGSEDTRKTISQLFAKNKESQREKEKLEAELATARSTNEDQRRHIEIRDQALSNAQAKVVKLEEELKKKQVYVDKVEKMQQALVQLQAACEKREQLEHRLRTRLERELESLRIQQRQGNCQPTNVSEYNAAALMELLREKEERILALEADMTKWEQKYLEENVMRHFALDAAATVAAQRDTTVISHSPNTSYDTALEARIQKEEEEILMANKRCLDMEGRIKTLHAQIIEKDAMIKVLQQRSRKEPSKTEQLSCMRPAKSLMSISNAGSGLLSHSSTLTGSPIMEEKRDDKSWKGSLGILLGGDYRAEYVPSTPSPVPPSTPLLSAHSKTGSRDCSTQTERGTESNKTAAVAPISVPAPVAAAATAAAITATAATITTTMVAAAPVAVAAAAAPAAAAAPSPATAAATAAAVSPAAAGQIPAAASVASAAAVAPSAAAAAAVQVAPAAPAPVPAPALVPVPAPAAAQASAPAQTQAPTSAPAVAPTPAPTPTPAVAQAEVPASPATGPGPHRLSIPSLTCNPDKTDGPVFHSNTLERKTPIQILGQEPDAEMVEYLI

SEQ ID NO: 4754 - protein, 597 aa, Homo sapiens
  Payload ID: 1043;
  Gene Symbol: AMOT;
  Gene Name: angiomotin;
  ENSP ID: ENSP00000361026
MEHRGPPPEYPFKGMPPQSVVCKPQEPGHFYSEHRLNQPGRTEGQLMRYQHPPEYGAARPAQDISLPLSARNSQPHSPTSSLTSGGSLPLLQSPPSTRLSPARHPLVPNQGDHSAHLPRPQQHFLPNQAHQGDHYRLSQPGLSQQQQQQQQQHHHHHHHQQQQQQQPQQQPGEAYSAMPRAQPSSASYQPVPADPFAIVSRAQQMVEILSDENRNLRQELEGCYEKVARLQKVETEIQRVSEAYENLVKSSSKREALEKAMRNKLEGEIRRMHDFNRDLRERLETANKQLAEKEYEGSEDTRKTISQLFAKNKESQREKEKLEAELATARSTNEDQRRHIEIRDQALSNAQAKVVKLEEELKKKQVYVDKVEKMQQALVQLQAACEKREQLEHRLRTRLERELESLRIQQRQGNCQPTNVSEYNAAALMELLREKEERILALEADMTKWEQKYLEENVMRHFALDAAATVAAQRDTTVISHSPNTSYDTALEARIQKEEEEILMANKRCLDMEGRIKTLHAQIIEKDAMIKVLQQRSRKEPSKTEQLSCMRPAKSLMSISNAGSGLLSHSSTLTGSPIMEEKRDDKSWKGSLGNDSK

SEQ ID NO: 4755 - protein, 1084 aa, Homo sapiens
  Payload ID: 1043;
  Gene Symbol: AMOT;
  Gene Name: angiomotin;
  Uniprot ID:  Q4VCS5;
  ENSP ID: ENSP00000361027
MRNSEEQPSGGTTVLQRLLQEQLRYGNPSENRSLLAIHQQATGNGPPFPSGSGNPGPQSDVLSPQDHHQQLVAHAARQEPQGQEIQSENLIMEKQLSPRMQNNEELPTYEEAKVQSQYFRGQQHASVGAAFYVTGVTNQKMRTEGRPSVQRLNPGKMHQDEGLRDLKQGHVRSLSERLMQMSLATSGVKAHPPVTSAPLSPPQPNDLYKNPTSSSEFYKAQGPLPNQHSLKGMEHRGPPPEYPFKGMPPQSVVCKPQEPGHFYSEHRLNQPGRTEGQLMRYQHPPEYGAARPAQDISLPLSARNSQPHSPTSSLTSGGSLPLLQSPPSTRLSPARHPLVPNQGDHSAHLPRPQQHFLPNQAHQGDHYRLSQPGLSQQQQQQQQQHHHHHHHQQQQQQQPQQQPGEAYSAMPRAQPSSASYQPVPADPFAIVSRAQQMVEILSDENRNLRQELEGCYEKVARLQKVETEIQRVSEAYENLVKSSSKREALEKAMRNKLEGEIRRMHDFNRDLRERLETANKQLAEKEYEGSEDTRKTISQLFAKNKESQREKEKLEAELATARSTNEDQRRHIEIRDQALSNAQAKVVKLEEELKKKQVYVDKVEKMQQALVQLQAACEKREQLEHRLRTRLERELESLRIQQRQGNCQPTNVSEYNAAALMELLREKEERILALEADMTKWEQKYLEENVMRHFALDAAATVAAQRDTTVISHSPNTSYDTALEARIQKEEEEILMANKRCLDMEGRIKTLHAQIIEKDAMIKVLQQRSRKEPSKTEQLSCMRPAKSLMSISNAGSGLLSHSSTLTGSPIMEEKRDDKSWKGSLGILLGGDYRAEYVPSTPSPVPPSTPLLSAHSKTGSRDCSTQTERGTESNKTAAVAPISVPAPVAAAATAAAITATAATITTTMVAAAPVAVAAAAAPAAAAAPSPATAAATAAAVSPAAAGQIPAAASVASAAAVAPSAAAAAAVQVAPAAPAPVPAPALVPVPAPAAAQASAPAQTQAPTSAPAVAPTPAPTPTPAVAQAEVPASPATGPGPHRLSIPSLTCNPDKTDGPVFHSNTLERKTPIQILGQEPDAEMVEYLI

SEQ ID NO: 4756 - protein, 852 aa, Homo sapiens
  Payload ID: 1043;
  Gene Symbol: AMOT;
  Gene Name: angiomotin;
  ENSP ID: ENSP00000361030
MEHRGPPPEYPFKGMPPQSVVCKPQEPGHFYSEHRLNQPGRTEGQLMRYQHPPEYGAARPAQDISLPLSARNSQPHSPTSSLTSGGSLPLLQSPPSTRLSPARHPLVPNQGDHSAHLPRPQQHFLPNQAHQGDHYRLSQPGLSQQQQQQQQQHHHHHHHQQQQQQQPQQQPGEAYSAMPRAQPSSASYQPVPADPFAIVSRAQQMVEILSDENRNLRQELEGCYEKVARLQKVETEIQRVSEAYENLVKSSSKREALEKAMRNKLEGEIRRMHDFNRDLRERLETANKQLAEKEYEGSEDTRKTISQLFAKNKESQREKEKLEAELATARSTNEDQRRHIEIRDQALSNAQAKVVKLEEELKKKQVYVDKVEKMQQALVQLQAACEKREQLEHRLRTRLERELESLRIQQRQGNCQPTNVSEYNAAALMELLREKEERILALEADMTKWEQKYLEENVMRHFALDAAATVAAQRDTTVISHSPNTSYDTALEARIQKEEEEILMANKRCLDMEGRIKTLHAQIIEKDAMIKVLQQRSRKEPSKTEQLSCMRPAKSLMSISNAGSGLLSHSSTLTGSPIMEEKRDDKSWKGSLGILLGGDYRAEYVPSTPSPVPPSTPLLSAHSKTGSRDCSTQTERGTESNKTAAVAPISVPAPVAAAATAAAITATAATITTTMVAAAPVAVAAAAAPAAAAAPSPATAAATAAAVSPAAAGQIPAAASVASAAAVAPSAAAAAAVQVAPAAPAPVPAPALVPVPAPAAAQASAPAQTQAPTSAPAVAPTPAPTPTPAVAQAEVPASPATGPGPHRLSIPSLTCNPDKTDGPVFHSNTLERKTPIQILGQEPDAEMVEYLI

SEQ ID NO: 4757 - protein, 1084 aa, Homo sapiens; identical to SEQ ID NO: 4755
  Payload ID: 1043;
  Gene Symbol: AMOT;
  Gene Name: angiomotin;
  Uniprot ID:  Q4VCS5;
  ENSP ID: ENSP00000429013

SEQ ID NO: 4758 - protein, 145 aa, Homo sapiens
  Payload ID: 1044;
  Gene Symbol: AMOTL1;
  Gene Name: angiomotin like 1;
  ENSP ID: ENSP00000299004
MDLSEKWTLEEGAWLSHAGIHHFASTRADSEFVEASPASYSPDELGSPSACYSPSSPVQVLEDSTYFSPDFQLYSGRHETSALTVEATSSIREKVVEDPLCNFHSPNFLRISEVEMRGSEDAAAGTVLQRLIQEQLRYGTPTENM

SEQ ID NO: 4759 - protein, 906 aa, Homo sapiens
  Payload ID: 1044;
  Gene Symbol: AMOTL1;
  Gene Name: angiomotin like 1;
  Uniprot ID:  Q8IY63;
  ENSP ID: ENSP00000320968
MWRAKLRRGTCEPAVKVEDPLCNFHSPNFLRISEVEMRGSEDAAAGTVLQRLIQEQLRYGTPTENMNLLAIQHQATGSAGPAHPTNNFSSTENLTQEDPQMVYQSARQEPQGQEHQVDNTVMEKQVRSTQPQQNNEELPTYEEAKAQSQFFRGQQQQQQQQGAVGHGYYMAGGTSQKSRTEGRPTVNRANSGQAHKDEALKELKQGHVRSLSERIMQLSLERNGAKQHLPGSGNGKGFKVGGGPSPAQPAGKVLDPRGPPPEYPFKTKQMMSPVSKTQEHGLFYGDQHPGMLHEMVKPYPAPQPVRTDVAVLRYQPPPEYGVTSRPCQLPFPSTMQQHSPMSSQTSSASGPLHSVSLPLPLPMALGAPQPPPAASPSQQLGPDAFAIVERAQQMVEILTEENRVLHQELQGYYDNADKLHKFEKELQRISEAYESLVKSTTKRESLDKAMRNKLEGEIRRLHDFNRDLRDRLETANRQLSSREYEGHEDKAAEGHYASQNKEFLKEKEKLEMELAAVRTASEDHRRHIEILDQALSNAQARVIKLEEELREKQAYVEKVEKLQQALTQLQSACEKREQMERRLRTWLERELDALRTQQKHGNGQPANMPEYNAPALLELVREKEERILALEADMTKWEQKYLEESTIRHFAMNAAATAAAERDTTIINHSRNGSYGESSLEAHIWQEEEEVVQANRRCQDMEYTIKNLHAKIIEKDAMIKVLQQRSRKDAGKTDSSSLRPARSVPSIAAATGTHSRQTSLTSSQLAEEKKEEKTWKGSIGLLLGKEHHEHASAPLLPPPPTSALSSIASTTAASSAHAKTGSKDSSTQTDKSAELFWPSMASLPSRGRLSTTPAHSPVLKHPAAKGTAEKLENSPGHGKSPDHRGRVSSLLHKPEFPDGEMMEVLI

SEQ ID NO: 4760 - protein, 956 aa, Homo sapiens
  Payload ID: 1044;
  Gene Symbol: AMOTL1;
  Gene Name: angiomotin like 1;
  Uniprot ID:  Q8IY63;
  ENSP ID: ENSP00000387739
MWRAKLRRGTCEPAVKGSPSACYSPSSPVQVLEDSTYFSPDFQLYSGRHETSALTVEATSSIREKVVEDPLCNFHSPNFLRISEVEMRGSEDAAAGTVLQRLIQEQLRYGTPTENMNLLAIQHQATGSAGPAHPTNNFSSTENLTQEDPQMVYQSARQEPQGQEHQVDNTVMEKQVRSTQPQQNNEELPTYEEAKAQSQFFRGQQQQQQQQGAVGHGYYMAGGTSQKSRTEGRPTVNRANSGQAHKDEALKELKQGHVRSLSERIMQLSLERNGAKQHLPGSGNGKGFKVGGGPSPAQPAGKVLDPRGPPPEYPFKTKQMMSPVSKTQEHGLFYGDQHPGMLHEMVKPYPAPQPVRTDVAVLRYQPPPEYGVTSRPCQLPFPSTMQQHSPMSSQTSSASGPLHSVSLPLPLPMALGAPQPPPAASPSQQLGPDAFAIVERAQQMVEILTEENRVLHQELQGYYDNADKLHKFEKELQRISEAYESLVKSTTKRESLDKAMRNKLEGEIRRLHDFNRDLRDRLETANRQLSSREYEGHEDKAAEGHYASQNKEFLKEKEKLEMELAAVRTASEDHRRHIEILDQALSNAQARVIKLEEELREKQAYVEKVEKLQQALTQLQSACEKREQMERRLRTWLERELDALRTQQKHGNGQPANMPEYNAPALLELVREKEERILALEADMTKWEQKYLEESTIRHFAMNAAATAAAERDTTIINHSRNGSYGESSLEAHIWQEEEEVVQANRRCQDMEYTIKNLHAKIIEKDAMIKVLQQRSRKDAGKTDSSSLRPARSVPSIAAATGTHSRQTSLTSSQLAEEKKEEKTWKGSIGLLLGKEHHEHASAPLLPPPPTSALSSIASTTAASSAHAKTGSKDSSTQTDKSAELFWPSMASLPSRGRLSTTPAHSPVLKHPAAKGTAEKLENSPGHGKSPDHRGRVSSLLHKPEFPDGEMMEVLI

SEQ ID NO: 4761 - protein, 780 aa, Homo sapiens
  Payload ID: 1045;
  Gene Symbol: AMOTL2;
  Gene Name: angiomotin like 2;
  Uniprot ID:  Q9Y2J4;
  ENSP ID: ENSP00000249883
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELRHGHVRSLSERLLQLSLERNGARAPSHMSSSHSFPQLARNQQGPPLRGPPAEGPESRGPPPQYPHVVLAHETTTAVTDPRYRARGSPHFQHAEVRILQAQVPPVFLQQQQQYQYLQQSQEHPPPPHPAALGHGPLSSLSPPAVEGPVSAQASSATSGSAHLAQMEAVLRENARLQRDNERLQRELESSAEKAGRIEKLESEIQRLSEAHESLTRASSKREALEKTMRNKMDSEMRRLQDFNRDLRERLESANRRLASKTQEAQAGSQDMVAKLLAQSYEQQQEQEKLEREMALLRGAIEDQRRRAELLEQALGNAQGRAARAEEELRKKQAYVEKVERLQQALGQLQAACEKREQLELRLRTRLEQELKALRAQQRQAGAPGGSSGSGGSPELSALRLSEQLREKEEQILALEADMTKWEQKYLEERAMRQFAMDAAATAAAQRDTTLIRHSPQPSPSSSFNEGLLTGGHRHQEMESRLKVLHAQILEKDAVIKVLQQRSRRDPGKAIQGSLRPAKSVPSVFAAAAAGTQGWQGLSSSERQTADAPARLTTADRAPTEEPVVTAPPAAHAKHGSRDGSTQTEGPPDSTSTCLPPEPDSLLGCSSSQRAASLDSVATSRVQDLSDMVEILI

SEQ ID NO: 4762 - protein, 779 aa, Homo sapiens
  Payload ID: 1045;
  Gene Symbol: AMOTL2;
  Gene Name: angiomotin like 2;
  Uniprot ID:  Q9Y2J4;
  ENSP ID: ENSP00000409999
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELRHGHVRSLSERLLQLSLERNGARAPSHMSSSHSFPQLARNQQGPPLRGPPAEGPESRGPPPQYPHVVLAHETTTAVTDPRYRARGSPHFQHAEVRILQAQVPPVFLQQQQQYQYLQQSQEHPPPPHPAALGHGPLSSLSPPAVEGPVSAQASSATSGSAHLAQMEAVLRENARLQRDNERLQRELESSAEKAGRIEKLESEIQRLSEAHESLTRASSKREALEKTMRNKMDSEMRRLQDFNRDLRERLESANRRLASKTQEAQAGSQDMVAKLLAQSYEQQQEQEKLEREMALLRGAIEDQRRRAELLEQALGNAQGRAARAEEELRKKQAYVEKVERLQQALGQLQAACEKREQLELRLRTRLEQELKALRAQQRQAGAPGGSSGSGGSPELSALRLSEQLREKEEQILALEADMTKWEQKYLEERAMRQFAMDAAATAAAQRDTTLIRHSPQPSPSSSFNEGLLTGGHRHQEMESRLKVLHAQILEKDAVIKVLQQRSRRDPGKAIQGSLRPAKSVPSVFAAAAAGTQGWQGLSSSERQTADAPARLTTDRAPTEEPVVTAPPAAHAKHGSRDGSTQTEGPPDSTSTCLPPEPDSLLGCSSSQRAASLDSVATSRVQDLSDMVEILI

SEQ ID NO: 4763 - protein, 33 aa, Homo sapiens
  Payload ID: 1045;
  Gene Symbol: AMOTL2;
  Gene Name: angiomotin like 2;
  ENSP ID: ENSP00000421521
MRTLEDSSGTVLHRLIQEQLRYGNLTETRTLLA

SEQ ID NO: 4764 - protein, 127 aa, Homo sapiens
  Payload ID: 1045;
  Gene Symbol: AMOTL2;
  Gene Name: angiomotin like 2;
  ENSP ID: ENSP00000422658
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPH

SEQ ID NO: 4765 - protein, 837 aa, Homo sapiens
  Payload ID: 1045;
  Gene Symbol: AMOTL2;
  Gene Name: angiomotin like 2;
  Uniprot ID:  Q9Y2J4;
  ENSP ID: ENSP00000424765
MTGRKASGGTPCTLRKGAPIITLGKNWTERLAAGDSVGCSGARCHRPLSRQLCASQRSMRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELRHGHVRSLSERLLQLSLERNGARAPSHMSSSHSFPQLARNQQGPPLRGPPAEGPESRGPPPQYPHVVLAHETTTAVTDPRYRARGSPHFQHAEVRILQAQVPPVFLQQQQQYQYLQQSQEHPPPPHPAALGHGPLSSLSPPAVEGPVSAQASSATSGSAHLAQMEAVLRENARLQRDNERLQRELESSAEKAGRIEKLESEIQRLSEAHESLTRASSKREALEKTMRNKMDSEMRRLQDFNRDLRERLESANRRLASKTQEAQAGSQDMVAKLLAQSYEQQQEQEKLEREMALLRGAIEDQRRRAELLEQALGNAQGRAARAEEELRKKQAYVEKVERLQQALGQLQAACEKREQLELRLRTRLEQELKALRAQQRQAGAPGGSSGSGGSPELSALRLSEQLREKEEQILALEADMTKWEQKYLEERAMRQFAMDAAATAAAQRDTTLIRHSPQPSPSSSFNEGLLTGGHRHQEMESRLKVLHAQILEKDAVIKVLQQRSRRDPGKAIQGSLRPAKSVPSVFAAAAAGTQGWQGLSSSERQTADAPARLTTDRAPTEEPVVTAPPAAHAKHGSRDGSTQTEGPPDSTSTCLPPEPDSLLGCSSSQRAASLDSVATSRVQDLSDMVEILI

SEQ ID NO: 4766 - protein, 151 aa, Homo sapiens
  Payload ID: 1045;
  Gene Symbol: AMOTL2;
  Gene Name: angiomotin like 2;
  ENSP ID: ENSP00000424910
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELR

SEQ ID NO: 4767 - protein, 777 aa, Homo sapiens
  Payload ID: 1045;
  Gene Symbol: AMOTL2;
  Gene Name: angiomotin like 2;
  Uniprot ID:  Q9Y2J4;
  ENSP ID: ENSP00000425475
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELRHGHVRSLSERLLQLSLERNGARAPSHMSSSHSFPQLARNQQGPPLRGPPAEGPESRGPPPQYPHVVLAHETTTAVTDPRYRARGSPHFQHAEVRILQAQVPPVFLQQQQQYQYLQQSQEHPPPPHPAALGHGPLSSLSPPAVEGPVSAQASSATSGSAHLAQMEAVLRENARLQRDNERLQRELESSAEKAGRIEKLESEIQRLSEAHESLTRASSKREALEKTMRNKMDSEMRRLQDFNRDLRERLESANRRLASKTQEAQAGSQDMVAKLLAQSYEQQQEQEKLEREMALLRGAIEDQRRRAELLEQALGNAQGRAARAEEELRKKQAYVEKVERLQQALGQLQAACEKREQLELRLRTRLEQELKALRAQQAGAPGGSSGSGGSPELSALRLSEQLREKEEQILALEADMTKWEQKYLEERAMRQFAMDAAATAAAQRDTTLIRHSPQPSPSSSFNEGLLTGGHRHQEMESRLKVLHAQILEKDAVIKVLQQRSRRDPGKAIQGSLRPAKSVPSVFAAAAAGTQGWQGLSSSERQTADAPARLTTDRAPTEEPVVTAPPAAHAKHGSRDGSTQTEGPPDSTSTCLPPEPDSLLGCSSSQRAASLDSVATSRVQDLSDMVEILI

SEQ ID NO: 4768 - protein, 198 aa, Homo sapiens
  Payload ID: 1045;
  Gene Symbol: AMOTL2;
  Gene Name: angiomotin like 2;
  ENSP ID: ENSP00000427184
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELRHGHVRSLSERLLQLSLERNGARAPSHMSSSHSFPQLARNQQGPPLRG

SEQ ID NO: 4769 - protein, 144 aa, Homo sapiens
  Payload ID: 1045;
  Gene Symbol: AMOTL2;
  Gene Name: angiomotin like 2;
  ENSP ID: ENSP00000427292
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQD

SEQ ID NO: 4770 - protein, 123 aa, Homo sapiens
  Payload ID: 1045;
  Gene Symbol: AMOTL2;
  Gene Name: angiomotin like 2;
  ENSP ID: ENSP00000427482
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAG

SEQ ID NO: 4771 - protein, 497 aa, Homo sapiens
  Payload ID: 1046;
  Gene Symbol: ANGPT1;
  Gene Name: angiopoietin 1;
  Uniprot ID:  Q15389;
  ENSP ID: ENSP00000297450
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 4772 - protein, 498 aa, Homo sapiens
  Payload ID: 1046;
  Gene Symbol: ANGPT1;
  Gene Name: angiopoietin 1;
  Uniprot ID:  Q15389;
  ENSP ID: ENSP00000428340
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 4773 - protein, 30 aa, Homo sapiens
  Payload ID: 1046;
  Gene Symbol: ANGPT1;
  Gene Name: angiopoietin 1;
  ENSP ID: ENSP00000428908
MKSEMAQIQQNAVQNHTATMLEIGTSLLSQ

SEQ ID NO: 4774 - protein, 297 aa, Homo sapiens
  Payload ID: 1046;
  Gene Symbol: ANGPT1;
  Gene Name: angiopoietin 1;
  ENSP ID: ENSP00000429349
MEGKHKEELDTLKEEKENLQGLVTRQTYIIQELEKQLNRATTNNSVLQKQQLELMDTVHNLVNLCTKEVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 4775 - protein, 298 aa, Homo sapiens
  Payload ID: 1046;
  Gene Symbol: ANGPT1;
  Gene Name: angiopoietin 1;
  ENSP ID: ENSP00000430750
MEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 4776 - protein, 496 aa, Homo sapiens
  Payload ID: 1047;
  Gene Symbol: ANGPT2;
  Gene Name: angiopoietin 2;
  Uniprot ID:  O15123;
  ENSP ID: ENSP00000314897
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 4777 - protein, 444 aa, Homo sapiens
  Payload ID: 1047;
  Gene Symbol: ANGPT2;
  Gene Name: angiopoietin 2;
  Uniprot ID:  O15123;
  ENSP ID: ENSP00000343517
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 4778 - protein, 459 aa, Homo sapiens
  Payload ID: 1047;
  Gene Symbol: ANGPT2;
  Gene Name: angiopoietin 2;
  ENSP ID: ENSP00000428023
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGRDDFLSSYLYWQGMIS

SEQ ID NO: 4779 - protein, 495 aa, Homo sapiens
  Payload ID: 1047;
  Gene Symbol: ANGPT2;
  Gene Name: angiopoietin 2;
  Uniprot ID:  O15123;
  ENSP ID: ENSP00000486858
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 4780 - protein, 503 aa, Homo sapiens
  Payload ID: 1048;
  Gene Symbol: ANGPT4;
  Gene Name: angiopoietin 4;
  Uniprot ID:  Q9Y264;
  ENSP ID: ENSP00000371347
MLSQLAMLQGSLLLVVATMSVAQQTRQEADRGCETLVVQHGHCSYTFLLPKSEPCPPGPEVSRDSNTLQRESLANPLHLGKLPTQQVKQLEQALQNNTQWLKKLERAIKTILRSKLEQVQQQMAQNQTAPMLELGTSLLNQTTAQIRKLTDMEAQLLNQTSRMDAQMPETFLSTNKLENQLLLQRQKLQQLQGQNSALEKRLQALETKQQEELASILSKKAKLLNTLSRQSAALTNIERGLRGVRHNSSLLQDQQHSLRQLLVLLRHLVQERANASAPAFIMAGEQVFQDCAEIQRSGASASGVYTIQVSNATKPRKVFCDLQSSGGRWTLIQRRENGTVNFQRNWKDYKQGFGDPAGEHWLGNEVVHQLTRRAAYSLRVELQDWEGHEAYAQYEHFHLGSENQLYRLSVVGYSGSAGRQSSLVLQNTSFSTLDSDNDHCLCKCAQVMSGGWWFDACGLSNLNGVYYHAPDNKYKMDGIRWHYFKGPSYSLRASRMMIRPLDI

SEQ ID NO: 4781 - protein, 491 aa, Homo sapiens
  Payload ID: 1049;
  Gene Symbol: ANGPTL1;
  Gene Name: angiopoietin-like 1;
  Uniprot ID:  O95841;
  ENSP ID: ENSP00000234816
MKTFTWTLGVLFFLLVDTGHCRGGQFKIKKINQRRYPRATDGKEEAKKCAYTFLVPEQRITGPICVNTKGQDASTIKDMITRMDLENLKDVLSRQKREIDVLQLVVDVDGNIVNEVKLLRKESRNMNSRVTQLYMQLLHEIIRKRDNSLELSQLENKILNVTTEMLKMATRYRELEVKYASLTDLVNNQSVMITLLEEQCLRIFSRQDTHVSPPLVQVVPQHIPNSQQYTPGLLGGNEIQRDPGYPRDLMPPPDLATSPTKSPFKIPPVTFINEGPFKDCQQAKEAGHSVSGIYMIKPENSNGPMQLWCENSLDPGGWTVIQKRTDGSVNFFRNWENYKKGFGNIDGEYWLGLENIYMLSNQDNYKLLIELEDWSDKKVYAEYSSFRLEPESEFYRLRLGTYQGNAGDSMMWHNGKQFTTLDRDKDMYAGNCAHFHKGGWWYNACAHSNLNGVWYRGGHYRSKHQDGIFWAEYRGGSYSLRAVQMMIKPID

SEQ ID NO: 4782 - protein, 491 aa, Homo sapiens; identical to SEQ ID NO: 4781
  Payload ID: 1049;
  Gene Symbol: ANGPTL1;
  Gene Name: angiopoietin-like 1;
  Uniprot ID:  O95841;
  ENSP ID: ENSP00000356601

SEQ ID NO: 4783 - protein, 114 aa, Homo sapiens
  Payload ID: 1049;
  Gene Symbol: ANGPTL1;
  Gene Name: angiopoietin-like 1;
  ENSP ID: ENSP00000392023
MKTFTWTLGVLFFLLVDTGHCRGGQFKIKKINQRRYPRATDGKEEAKKCAYTFLVPEQRITGPICVNTKGQDASTIKDMITRMDLENLKDVLSRQKREIDVLQLVVDVDGNIVN

SEQ ID NO: 4784 - protein, 191 aa, Homo sapiens
  Payload ID: 1050;
  Gene Symbol: ANGPTL2;
  Gene Name: angiopoietin-like 2;
  Uniprot ID:  Q9UKU9;
  ENSP ID: ENSP00000362516
MQVWCDQRHDPGGWTVIQRRLDGSVNFFRNWETYKQGFGNIDGEYWLGLENIYWLTNQGNYKLLVTMEDWSGRKVFAEYASFRLEPESEYYKLRLGRYHGNAGDSFTWHNGKQFTTLDRDHDVYTGNCAHYQKGGWWYNACAHSNLNGVWYRGGHYRSRYQDGVYWAEFRGGSYSLKKVVMMIRPNPNTFH

SEQ ID NO: 4785 - protein, 493 aa, Homo sapiens
  Payload ID: 1050;
  Gene Symbol: ANGPTL2;
  Gene Name: angiopoietin-like 2;
  Uniprot ID:  Q9UKU9;
  ENSP ID: ENSP00000362524
MRPLCVTCWWLGLLAAMGAVAGQEDGFEGTEEGSPREFIYLNRYKRAGESQDKCTYTFIVPQQRVTGAICVNSKEPEVLLENRVHKQELELLNNELLKQKRQIETLQQLVEVDGGIVSEVKLLRKESRNMNSRVTQLYMQLLHEIIRKRDNALELSQLENRILNQTADMLQLASKYKDLEHKYQHLATLAHNQSEIIAQLEEHCQRVPSARPVPQPPPAAPPRVYQPPTYNRIINQISTNEIQSDQNLKVLPPPLPTMPTLTSLPSSTDKPSGPWRDCLQALEDGHDTSSIYLVKPENTNRLMQVWCDQRHDPGGWTVIQRRLDGSVNFFRNWETYKQGFGNIDGEYWLGLENIYWLTNQGNYKLLVTMEDWSGRKVFAEYASFRLEPESEYYKLRLGRYHGNAGDSFTWHNGKQFTTLDRDHDVYTGNCAHYQKGGWWYNACAHSNLNGVWYRGGHYRSRYQDGVYWAEFRGGSYSLKKVVMMIRPNPNTFH

SEQ ID NO: 4786 - protein, 460 aa, Homo sapiens
  Payload ID: 1051;
  Gene Symbol: ANGPTL3;
  Gene Name: angiopoietin-like 3;
  Uniprot ID:  Q9Y5C1;
  ENSP ID: ENSP00000360170
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKTFVEKQDNSIKDLLQTVEDQYKQLNQQHSQIKEIENQLRRTSIQEPTEISLSSKPRAPRTTPFLQLNEIRNVKHDGIPAECTTIYNRGEHTSGMYAIRPSNSQVFHVYCDVISGSPWTLIQHRIDGSQNFNETWENYKYGFGRLDGEFWLGLEKIYSIVKQSNYVLRIELEDWKDNKHYIEYSFYLGNHETNYTLHLVAITGNVPNAIPENKDLVFSTWDHKAKGHFNCPEGYSGGWWWHDECGENNLNGKYNKPRAKSKPERRRGLSWKSQNGRLYSIKSTKMLIHPTDSESFE

SEQ ID NO: 4787 - protein, 406 aa, Homo sapiens
  Payload ID: 1052;
  Gene Symbol: ANGPTL4;
  Gene Name: angiopoietin-like 4;
  Uniprot ID:  Q9BY76;
  ENSP ID: ENSP00000301455
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQFGLLDHKHLDHEVAKPARRKRLPEMAQPVDPAHNVSRLHRLPRDCQELFQVGERQSGLFEIQPQGSPPFLVNCKMTSDGGWTVIQRRHDGSVDFNRPWEAYKAGFGDPHGEFWLGLEKVHSITGDRNSRLAVQLRDWDGNAELLQFSVHLGGEDTAYSLQLTAPVAGQLGATTVPPSGLSVPFSTWDQDHDLRRDKNCAKSLSGGWWFGTCSHSNLNGQYFRSIPQQRQKLKKGIFWKTWRGRYYPLQATTMLIQPMAAEAAS

SEQ ID NO: 4788 - protein, 368 aa, Homo sapiens
  Payload ID: 1052;
  Gene Symbol: ANGPTL4;
  Gene Name: angiopoietin-like 4;
  Uniprot ID:  Q9BY76;
  ENSP ID: ENSP00000377534
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQFGLLDHKHLDHEVAKPARRKRLPEMAQPVDPAHNVSRLHHGGWTVIQRRHDGSVDFNRPWEAYKAGFGDPHGEFWLGLEKVHSITGDRNSRLAVQLRDWDGNAELLQFSVHLGGEDTAYSLQLTAPVAGQLGATTVPPSGLSVPFSTWDQDHDLRRDKNCAKSLSGGWWFGTCSHSNLNGQYFRSIPQQRQKLKKGIFWKTWRGRYYPLQATTMLIQPMAAEAAS

SEQ ID NO: 4789 - protein, 96 aa, Homo sapiens
  Payload ID: 1052;
  Gene Symbol: ANGPTL4;
  Gene Name: angiopoietin-like 4;
  ENSP ID: ENSP00000470307
MSGAPTAGAALMLCAATAVLLSAQGGPVQSKSPRFASWDEMNVLAHGLLQLGQGLREHAERTRSQLSALERRLSACGSACQGTEGSTDLPLAPESR

SEQ ID NO: 4790 - protein, 85 aa, Homo sapiens
  Payload ID: 1052;
  Gene Symbol: ANGPTL4;
  Gene Name: angiopoietin-like 4;
  ENSP ID: ENSP00000471345
MSGAPTAGAALMLCAATAVLLSAQGGPVQSKSPRFASWDEMNVLAHGLLQLGQGLREHAERTRSQLSALERRLSACGSACQGTEG

SEQ ID NO: 4791 - protein, 406 aa, Homo sapiens; identical to SEQ ID NO: 4787
  Payload ID: 1052;
  Gene Symbol: ANGPTL4;
  Gene Name: angiopoietin-like 4;
  Uniprot ID:  Q9BY76;
  ENSP ID: ENSP00000472551

SEQ ID NO: 4792 - protein, 129 aa, Homo sapiens
  Payload ID: 1052;
  Gene Symbol: ANGPTL4;
  Gene Name: angiopoietin-like 4;
  ENSP ID: ENSP00000472869
  MOD_RES (1)..(1): Any amino acid
XPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQTGLNGGLSHID

SEQ ID NO: 4793 - protein, 128 aa, Homo sapiens
  Payload ID: 1052;
  Gene Symbol: ANGPTL4;
  Gene Name: angiopoietin-like 4;
  ENSP ID: ENSP00000473025
MSGAPTAGAALMLCAATAVLLSAQGGPVQSKSPRFASWDEMNVLAHGLLQLGQGLREHAERTRSQLSALERRLSACGSFTACRHNSRLRTAGSSNSSTRWPSSSGTWRSSTCEFSICKASLASWTTST

SEQ ID NO: 4794 - protein, 104 aa, Homo sapiens
  Payload ID: 1052;
  Gene Symbol: ANGPTL4;
  Gene Name: angiopoietin-like 4;
  ENSP ID: ENSP00000473090
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHS

SEQ ID NO: 4795 - protein, 388 aa, Homo sapiens
  Payload ID: 1053;
  Gene Symbol: ANGPTL5;
  Gene Name: angiopoietin-like 5;
  Uniprot ID:  Q86XS5;
  ENSP ID: ENSP00000335255
MMSPSQASLLFLNVCIFICGEAVQGNCVHHSTDSSVVNIVEDGSNAKDESKSNDTVCKEDCEESCDVKTKITREEKHFMCRNLQNSIVSYTRSTKKLLRNMMDEQQASLDYLSNQVNELMNRVLLLTTEVFRKQLDPFPHRPVQSHGLDCTDIKDTIGSVTKTPSGLYIIHPEGSSYPFEVMCDMDYRGGGRTVIQKRIDGIIDFQRLWCDYLDGFGDLLGEFWLGLKKIFYIVNQKNTSFMLYVALESEDDTLAYASYDNFWLEDETRFFKMHLGRYSGNAGDAFRGLKKEDNQNAMPFSTSDVDNDGCRPACLVNGQSVKSCSHLHNKTGWWFNECGLANLNGIHHFSGKLLATGIQWGTWTKNNSPVKIKSVSMKIRRMYNPYFK

SEQ ID NO: 4796 - protein, 192 aa, Homo sapiens
  Payload ID: 1053;
  Gene Symbol: ANGPTL5;
  Gene Name: angiopoietin-like 5;
  ENSP ID: ENSP00000433562
MMSPSQASLLFLNVCIFICGEAVQGNCVHHSTDSSVVNIVEDGSNAKDESKSNDTVCKEDCEESCDVKTKITREEKHFMCRNLQNSIVSYTRSTKKLLRNMMDEQQASLDYLSNQVMCDMDYRGGGRTVIQKRIDGIIDFQRLWCDYLDGFGDLLGEFWLGLKKIFYIVNQKNTSFMLYVALESEDDTLAYA

SEQ ID NO: 4797 - protein, 470 aa, Homo sapiens
  Payload ID: 1054;
  Gene Symbol: ANGPTL6;
  Gene Name: angiopoietin-like 6;
  Uniprot ID:  Q8NI99;
  ENSP ID: ENSP00000253109
MGKPWLRALQLLLLLGASWARAGAPRCTYTFVLPPQKFTGAVCWSGPASTRATPEAANASELAALRMRVGRHEELLRELQRLAAADGAVAGEVRALRKESRGLSARLGQLRAQLQHEAGPGAGPGADLGAEPAAALALLGERVLNASAEAQRAAARFHQLDVKFRELAQLVTQQSSLIARLERLCPGGAGGQQQVLPPPPLVPVVPVRLVGSTSDTSRMLDPAPEPQRDQTQRQQEPMASPMPAGHPAVPTKPVGPWQDCAEARQAGHEQSGVYELRVGRHVVSVWCEQQLEGGGWTVIQRRQDGSVNFFTTWQHYKAGFGRPDGEYWLGLEPVYQLTSRGDHELLVLLEDWGGRGARAHYDGFSLEPESDHYRLRLGQYHGDAGDSLSWHNDKPFSTVDRDRDSYSGNCALYQRGGWWYHACAHSNLNGVWHHGGHYRSRYQDGVYWAEFRGGAYSLRKAAMLIRPLKL

SEQ ID NO: 4798 - protein, 430 aa, Homo sapiens
  Payload ID: 1054;
  Gene Symbol: ANGPTL6;
  Gene Name: angiopoietin-like 6;
  ENSP ID: ENSP00000465597
MGKPWLRALQLLLLLGASWARAGAPRCTYTFVLPPQKFTGAVCWSGPASTRATPEAANASELAALRMRVGRHEELLRELQRLAAADGAVAGEVRALRKESRGLSARLGQLRAQLQHEAGPGAGPGADLGAEPAAALALLGERVLNASAEAQRAAARFHQLDVKFRELAQLVTQQSSLIARLERLCPGGAGGQQQVLPPPPLVPVVPVRLVGSTSDTSRMLDPAPEPQRDQTQRQQEPMASPMPAGHPAVPTKPVGPWQDCAEARQAGHEQSGVYELRAGFGRPDGEYWLGLEPVYQLTSRGDHELLVLLEDWGGRGARAHYDGFSLEPESDHYRLRLGQYHGDAGDSLSWHNDKPFSTVDRDRDSYSGNCALYQRGGWWYHACAHSNLNGVWHHGGHYRSRYQDGVYWAEFRGGAYSLRKAAMLIRPLKL

SEQ ID NO: 4799 - protein, 470 aa, Homo sapiens; identical to SEQ ID NO: 4797
  Payload ID: 1054;
  Gene Symbol: ANGPTL6;
  Gene Name: angiopoietin-like 6;
  Uniprot ID:  Q8NI99;
  ENSP ID: ENSP00000467930

SEQ ID NO: 4800 - protein, 346 aa, Homo sapiens
  Payload ID: 1055;
  Gene Symbol: ANGPTL7;
  Gene Name: angiopoietin-like 7;
  Uniprot ID:  O43827;
  ENSP ID: ENSP00000366015
MLKKPLSAVTWLCIFIVAFVSHPAWLQKLSKHKTPAQPQLKAANCCEEVKELKAQVANLSSLLSELNKKQERDWVSVVMQVMELESNSKRMESRLTDAESKYSEMNNQIDIMQLQAAQTVTQTSADAIYDCSSLYQKNYRISGVYKLPPDDFLGSPELEVFCDMETSGGGWTIIQRRKSGLVSFYRDWKQYKQGFGSIRGDFWLGNEHIHRLSRQPTRLRVEMEDWEGNLRYAEYSHFVLGNELNSYRLFLGNYTGNVGNDALQYHNNTAFSTKDKDNDNCLDKCAQLRKGGYWYNCCTDSNLNGVYYRLGEHNKHLDGITWYGWHGSTYSLKRVEMKIRPEDFKP

SEQ ID NO: 4801 - protein, 732 aa, Homo sapiens
  Payload ID: 1056;
  Gene Symbol: ACE;
  Gene Name: angiotensin I converting enzyme;
  Uniprot ID:  P12821;
  ENSP ID: ENSP00000290863
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 4802 - protein, 1306 aa, Homo sapiens
  Payload ID: 1056;
  Gene Symbol: ACE;
  Gene Name: angiotensin I converting enzyme;
  Uniprot ID:  P12821;
  ENSP ID: ENSP00000290866
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 4803 - protein, 691 aa, Homo sapiens
  Payload ID: 1056;
  Gene Symbol: ACE;
  Gene Name: angiotensin I converting enzyme;
  Uniprot ID:  P12821;
  ENSP ID: ENSP00000392247
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRTAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 4804 - protein, 1242 aa, Homo sapiens
  Payload ID: 1056;
  Gene Symbol: ACE;
  Gene Name: angiotensin I converting enzyme;
  ENSP ID: ENSP00000397593
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSGTATHPTSSLGS

SEQ ID NO: 4805 - protein, 145 aa, Homo sapiens
  Payload ID: 1056;
  Gene Symbol: ACE;
  Gene Name: angiotensin I converting enzyme;
  ENSP ID: ENSP00000462002
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILGLYDTWGSSLLCPCLDMCCLTAGIQGGCRRTCK

SEQ ID NO: 4806 - protein, 36 aa, Homo sapiens
  Payload ID: 1056;
  Gene Symbol: ACE;
  Gene Name: angiotensin I converting enzyme;
  ENSP ID: ENSP00000462110
MGQGWATAGLPSLLFLLLCYGHPLLVPSQEASQQTW

SEQ ID NO: 4807 - protein, 314 aa, Homo sapiens
  Payload ID: 1056;
  Gene Symbol: ACE;
  Gene Name: angiotensin I converting enzyme;
  ENSP ID: ENSP00000462280
MDEGGCSQAAPAFAEGAGLGSGAPALSGSCLLTSGRCRCHRHRTALSIHPPLARPLFWSQFLLHHSHEADSLQKEEARLPQTKEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQ

SEQ ID NO: 4808 - protein, 208 aa, Homo sapiens
  Payload ID: 1056;
  Gene Symbol: ACE;
  Gene Name: angiotensin I converting enzyme;
  ENSP ID: ENSP00000462599
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPALKFSELPLQAEVS

SEQ ID NO: 4809 - protein, 282 aa, Homo sapiens
  Payload ID: 1056;
  Gene Symbol: ACE;
  Gene Name: angiotensin I converting enzyme;
  ENSP ID: ENSP00000462909
LDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNEHDINFLMKMALDKIAFIPFSYLVDQWRWRVFDGSITKENYNQEWWSLRLKYQGLCPPVP

SEQ ID NO: 4810 - protein, 168 aa, Homo sapiens
  Payload ID: 1056;
  Gene Symbol: ACE;
  Gene Name: angiotensin I converting enzyme;
  ENSP ID: ENSP00000462995
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQISPTSWLPREATPCSCLPGRAGTTLRASR

SEQ ID NO: 4811 - protein, 119 aa, Homo sapiens
  Payload ID: 1056;
  Gene Symbol: ACE;
  Gene Name: angiotensin I converting enzyme;
  ENSP ID: ENSP00000463673
  MOD_RES (1)..(1): Any amino acid
XQAGSSRPWQEVLKDMVGLDALDAQPLLKYFQPVTQWLQEQNQQNGEVLGWPEYQWHPPLPDNYPEGIGDSHPWDKQPGNNQQPDNHPPGDGPPDISPEPKWDHAGEGQGARGGRGGAG

SEQ ID NO: 4812 - protein, 138 aa, Homo sapiens
  Payload ID: 1056;
  Gene Symbol: ACE;
  Gene Name: angiotensin I converting enzyme;
  ENSP ID: ENSP00000464428
  MOD_RES (1)..(1): Any amino acid
XRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSGTATHPTSSLGS

SEQ ID NO: 4813 - protein, 36 aa, Homo sapiens; identical to SEQ ID NO: 4806
  Payload ID: 1056;
  Gene Symbol: ACE;
  Gene Name: angiotensin I converting enzyme;
  ENSP ID: ENSP00000464629

SEQ ID NO: 4814 - protein, 805 aa, Homo sapiens [sequence omitted]

SEQ ID NO: 4815 - protein, 805 aa, Homo sapiens [sequence omitted]

SEQ ID NO: 4816 - protein, 359 aa, Homo sapiens [sequence omitted]

SEQ ID NO: 4817 - protein, 359 aa, Homo sapiens [sequence omitted]

SEQ ID NO: 4818 - protein, 388 aa, Homo sapiens
  Payload ID: 1058;
  Gene Symbol: AGTR1;
  Gene Name: angiotensin II receptor, type 1;
  ENSP ID: ENSP00000385641
MLTFTSECGCTTFGVFDIVFATNSTQVIKMILNSSTEDGIKRIQDDCPKAGRHNYIFVMIPTLYSIIFVVGIFGNSLVVIVIYFYMKLKTVASVFLLNLALADLCFLLTLPLWAVYTAMEYRWPFGNYLCKIASASVSFNLYASVFLLTCLSIDRYLAIVHPMKSRLRRTMLVAKVTCIIIWLLAGLASLPAIIHRNVFFIENTNITVCAFHYESQNSTLPIGLGLTKNILGFLFPFLIILTSYTLIWKALKKAYEIQKNKPRNDDIFKIIMAIVLFFFFSWIPHQIFTFLDVLIQLGIIRDCRIADIVDTAMPITICIAYFNNCLNPLFYGFLGKKFKRYFLQLLKYIPPKAKSHSNLSTKMSTLSYRPSDNVSSSTKKPAPCFEVE

SEQ ID NO: 4819 - protein, 394 aa, Homo sapiens
  Payload ID: 1058;
  Gene Symbol: AGTR1;
  Gene Name: angiotensin II receptor, type 1;
  ENSP ID: ENSP00000398832
MKKMNHKSTDSPKAPQLRGGVFDIVFATNSTQVIKMILNSSTEDGIKRIQDDCPKAGRHNYIFVMIPTLYSIIFVVGIFGNSLVVIVIYFYMKLKTVASVFLLNLALADLCFLLTLPLWAVYTAMEYRWPFGNYLCKIASASVSFNLYASVFLLTCLSIDRYLAIVHPMKSRLRRTMLVAKVTCIIIWLLAGLASLPAIIHRNVFFIENTNITVCAFHYESQNSTLPIGLGLTKNILGFLFPFLIILTSYTLIWKALKKAYEIQKNKPRNDDIFKIIMAIVLFFFFSWIPHQIFTFLDVLIQLGIIRDCRIADIVDTAMPITICIAYFNNCLNPLFYGFLGKKFKRYFLQLLKYIPPKAKSHSNLSTKMSTLSYRPSDNVSSSTKKPAPCFEVE

SEQ ID NO: 4820 - protein, 359 aa, Homo sapiens [sequence omitted]

SEQ ID NO: 4821 - protein, 359 aa, Homo sapiens [sequence omitted]

SEQ ID NO: 4822 - protein, 359 aa, Homo sapiens [sequence omitted]

SEQ ID NO: 4823 - protein, 359 aa, Homo sapiens [sequence omitted]

SEQ ID NO: 4824 - protein, 363 aa, Homo sapiens
  Payload ID: 1059;
  Gene Symbol: AGTR2;
  Gene Name: angiotensin II receptor, type 2;
  Uniprot ID:  P50052;
  ENSP ID: ENSP00000360973
MKGNSTLATTSKNITSGLHFGLVNISGNNESTLNCSQKPSDKHLDAIPILYYIIFVIGFLVNIVVVTLFCCQKGPKKVSSIYIFNLAVADLLLLATLPLWATYYSYRYDWLFGPVMCKVFGSFLTLNMFASIFFITCMSVDRYQSVIYPFLSQRRNPWQASYIVPLVWCMACLSSLPTFYFRDVRTIEYLGVNACIMAFPPEKYAQWSAGIALMKNILGFIIPLIFIATCYFGIRKHLLKTNSYGKNRITRDQVLKMAAAVVLAFIICWLPFHVLTFLDALAWMGVINSCEVIAVIDLALPFAILLGFTNSCVNPFLYCFVGNRFQQKLRSVFRVPITWLQGKRESMSCRKSSSLREMETFVS

SEQ ID NO: 4825 - protein, 159 aa, Homo sapiens
  Payload ID: 1060;
  Gene Symbol: AGTRAP;
  Gene Name: angiotensin II receptor-associated prt;
  Uniprot ID:  Q6RW13;
  ENSP ID: ENSP00000319713
MELPAVNLKVILLGHWLLTTWGCIVFSGSYAWANFTILALGVWAVAQRDSIDAISMFLGGLLATIFLDIVHISIFYPRVSLTDTGRFGVGMAILSLLLKPLSCCFVYHMYRERGGELLVHTGFLGSSQDRSAYQTIDSAEAPADPFAVPEGRSQDARGY

SEQ ID NO: 4826 - protein, 159 aa, Homo sapiens
  Payload ID: 1060;
  Gene Symbol: AGTRAP;
  Gene Name: angiotensin II receptor-associated prt;
  ENSP ID: ENSP00000365814
MELPAVNLKCASSSVPRNHPHVILLGHWLLTTCFWRHFSAKPRLETIELTCALCKLRSAAHRATAGLHCILRLLCLGQLHHPGLGRVGCGSAGLHRRHKHVSGWLAGHHLPGHRAHQHLLPAGQPHGHGPLWRGHGHPQLAAQAALLLLRLPHVPGARG

SEQ ID NO: 4827 - protein, 152 aa, Homo sapiens
  Payload ID: 1060;
  Gene Symbol: AGTRAP;
  Gene Name: angiotensin II receptor-associated prt;
  Uniprot ID:  Q6RW13;
  ENSP ID: ENSP00000365816
MELPAVNLKVILLGHWLLTTWGCIVFSGSYAWANFTILALGVWAVAQRDSIDAISMFLGGLLATIFLDIVHISIFYPRVSLTDTGRFGVGMAILSLLLKPLSCCFVYHMYRERGGFLGSSQDRSAYQTIDSAEAPADPFAVPEGRSQDARGY

SEQ ID NO: 4828 - protein, 111 aa, Homo sapiens
  Payload ID: 1060;
  Gene Symbol: AGTRAP;
  Gene Name: angiotensin II receptor-associated prt;
  Uniprot ID:  Q6RW13;
  ENSP ID: ENSP00000365824
MELPAVNLKGLHCILRLLCLGQLHHPGLGRVGCGSAGLHRRHKHVSGWLAGHHLPGHRAHQHLLPAGQPHGHGPLWRGHGHPQLAAQAALLLLRLPHVPGARGFPWVFSGP

SEQ ID NO: 4829 - protein, 147 aa, Homo sapiens
  Payload ID: 1060;
  Gene Symbol: AGTRAP;
  Gene Name: angiotensin II receptor-associated prt;
  Uniprot ID:  Q6RW13;
  ENSP ID: ENSP00000383688
MELPAVNLKVILLGHWLLTTCFWRHFSAKPRLETIELTCALCKLRSAAHRATAGLHCILRLLCLGQLHHPGLGRVGCGSAGLHRRHKHVSGWLAGHHLPGHRAHQHLLPAGQPHGHGPLWRGHGHPQLAAQAALLLLRLPHVPGARG

SEQ ID NO: 4830 - protein, 155 aa, Homo sapiens
  Payload ID: 1060;
  Gene Symbol: AGTRAP;
  Gene Name: angiotensin II receptor-associated prt;
  Uniprot ID:  Q6RW13;
  ENSP ID: ENSP00000408505
MELPAVNLKVILLGHWLLTTCFWRHFSAKPRLETIELTCALCKLRSAAHRATAGLHCILRLLCLGQLHHPGLGRVGCGSAGLHRRHKHVSGWLAGHHLPGHRAHQHLLPAGQPHGHGPLWRGHGHPQLAAQAALLLLRLPHVPGARGFPWVFSGP

SEQ ID NO: 4831 - protein, 155 aa, Homo sapiens
  Payload ID: 1060;
  Gene Symbol: AGTRAP;
  Gene Name: angiotensin II receptor-associated prt;
  ENSP ID: ENSP00000422647
MELPAVNLKVILLGHWLLTTCFWVACWPPSSWTSCTSASSTRGSASRTRAALAWAWPSSACCSSRSPAASSTTCTGSAGVSSWSTLVSLGLLRTVVPTRRLTQQRRPQIPLQSQRAGVKMPEGTEASHAAPGPAPGLPRAWEVVLGMLLTSVSWT

SEQ ID NO: 4832 - protein, 63 aa, Homo sapiens
  Payload ID: 1060;
  Gene Symbol: AGTRAP;
  Gene Name: angiotensin II receptor-associated prt;
  ENSP ID: ENSP00000424455
MELPAVNLKVILLGHWLLTTWHKDCTPCRSWEGDVEVLIRAPQGLPHSEASALQLDFHLYHLF

SEQ ID NO: 4833 - protein, 485 aa, Homo sapiens
  Payload ID: 1061;
  Gene Symbol: AGT;
  Gene Name: angiotensinogen (serpin peptidase inhibitor, clade A, member 8);
  Uniprot ID:  P01019;
  ENSP ID: ENSP00000355627
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLMGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 4834 - protein, 1124 aa, Homo sapiens
  Payload ID: 1062;
  Gene Symbol: ANLN;
  Gene Name: anillin actin binding prt;
  Uniprot ID:  Q9NQW6;
  ENSP ID: ENSP00000265748
MDPFTEKLLERTRARRENLQRKMAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPRPLLSNASATPVGRRGRLANLAATICSWEDDVNHSFAKQNSVQEQPGTACLSKFSSASGASARINSSSVKQEATFCSQRDGDASLNKALSSSADDASLVNASISSSVKATSPVKSTTSITDAKSCEGQNPELLPKTPISPLKTGVSKPIVKSTLSQTVPSKGELSREICLQSQSKDKSTTPGGTGIKPFLERFGERCQEHSKESPARSTPHRTPIITPNTKAIQERLFKQDTSSSTTHLAQQLKQERQKELACLRGRFDKGNIWSAEKGGNSKSKQLETKQETHCQSTPLKKHQGVSKTQSLPVTEKVTENQIPAKNSSTEPKGFTECEMTKSSPLKITLFLEEDKSLKVTSDPKVEQKIEVIREIEMSVDDDDINSSKVINDLFSDVLEEGELDMEKSQEEMDQALAESSEEQEDALNISSMSLLAPLAQTVGVVSPESLVSTPRLELKDTSRSDESPKPGKFQRTRVPRAESGDSLGSEDRDLLYSIDAYRSQRFKETERPSIKQVIVRKEDVTSKLDEKNNAFPCQVNIKQKMQELNNEINMQQTVIYQASQALNCCVDEEHGKGSLEEAEAERLLLIATGKRTLLIDELNKLKNEGPQRKNKASPQSEFMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRETLVSQCRDTLCVTKNWLSADTKEERDLWMQKLNQVLVDIRLWQPDACYKPIGKP

SEQ ID NO: 4835 - protein, 1087 aa, Homo sapiens
  Payload ID: 1062;
  Gene Symbol: ANLN;
  Gene Name: anillin actin binding prt;
  Uniprot ID:  Q9NQW6;
  ENSP ID: ENSP00000379380
MDPFTEKLLERTRARRENLQRKMAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPRPLLSNASATPVGRRGRLANLAATICSWEDDVNHSFAKQNSVQEQPGTACLSKFSSASGASARINSSSVKQEATFCSQRDGDASLNKALSSSADDASLVNASISSSVKATSPVKSTTSITDAKSCEGQNPELLPKTPISPLKTGVSKPIVKSTLSQTVPSKGELSREICLQSQSKDKSTTPGGTGIKPFLERFGERCQEHSKESPARSTPHRTPIITPNTKAIQERLFKQDTSSSTTHLAQQLKQERQKELACLRGRFDKGNIWSAEKGGNSKSKQLETKQETHCQSTPLKKHQGVSKTQSLPVTEKVTENQIPAKNSSTEPKEVIREIEMSVDDDDINSSKVINDLFSDVLEEGELDMEKSQEEMDQALAESSEEQEDALNISSMSLLAPLAQTVGVVSPESLVSTPRLELKDTSRSDESPKPGKFQRTRVPRAESGDSLGSEDRDLLYSIDAYRSQRFKETERPSIKQVIVRKEDVTSKLDEKNNAFPCQVNIKQKMQELNNEINMQQTVIYQASQALNCCVDEEHGKGSLEEAEAERLLLIATGKRTLLIDELNKLKNEGPQRKNKASPQSEFMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRETLVSQCRDTLCVTKNWLSADTKEERDLWMQKLNQVLVDIRLWQPDACYKPIGKP

SEQ ID NO: 4836 - protein, 69 aa, Homo sapiens
  Payload ID: 1062;
  Gene Symbol: ANLN;
  Gene Name: anillin actin binding prt;
  ENSP ID: ENSP00000397465
  MOD_RES (1)..(1): Any amino acid
XFSSASGASARINSSSVKQEATFCSQRDGDASLNKALSSSADDASLVNASISSSVVKSYFSSEIYYIYH

SEQ ID NO: 4837 - protein, 73 aa, Homo sapiens
  Payload ID: 1062;
  Gene Symbol: ANLN;
  Gene Name: anillin actin binding prt;
  ENSP ID: ENSP00000398712
KFSSASGASARINSSSVKQEATFCSQRDGDASLNKALSSSADDASLVNASISSSVCFHVSESYFSSEIYYIYH

SEQ ID NO: 4838 - protein, 252 aa, Homo sapiens
  Payload ID: 1062;
  Gene Symbol: ANLN;
  Gene Name: anillin actin binding prt;
  ENSP ID: ENSP00000399553
  MOD_RES (1)..(1): Any amino acid
XMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHSSVMASPGGLSAVRTSNFALVGSYTLSLSSVGNTKFVLDKINYDVRERELLGYLFQEKVPFLSSLEGHIYLKIKCQVNSSVEERGFLTIFEDVSGFGAWHRRWCVLSGNCISYWTYPDDEKRKNPIG

SEQ ID NO: 4839 - protein, 276 aa, Homo sapiens
  Payload ID: 1062;
  Gene Symbol: ANLN;
  Gene Name: anillin actin binding prt;
  ENSP ID: ENSP00000400777
  MOD_RES (1)..(1): Any amino acid
XPKPGKFQRTRVPRAESGDSLGSEDRDLLYRSQRFKETERPSIKQVIVRKEDVTSKLDEKNNAFPCQVNIKQKMQELNNEINMQQTVIYQASQALNCCVDEEHGKGSLEEAEAERLLLIATGKRTLLIDELNKLKNEGPQRKNKASPQSEFMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHS

SEQ ID NO: 4840 - protein, 169 aa, Homo sapiens
  Payload ID: 1062;
  Gene Symbol: ANLN;
  Gene Name: anillin actin binding prt;
  ENSP ID: ENSP00000404979
MAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPRPLLSNA

SEQ ID NO: 4841 - protein, 36 aa, Homo sapiens
  Payload ID: 1062;
  Gene Symbol: ANLN;
  Gene Name: anillin actin binding prt;
  ENSP ID: ENSP00000406584
MAERPTAAPRSMTHAKRARQPLSEASNQQPLSGGEG

SEQ ID NO: 4842 - protein, 26 aa, Homo sapiens
  Payload ID: 1062;
  Gene Symbol: ANLN;
  Gene Name: anillin actin binding prt;
  ENSP ID: ENSP00000413441
  MOD_RES (1)..(1): Any amino acid
XSLVNASISSSVVKSYFSSEIYYIYH

SEQ ID NO: 4843 - protein, 236 aa, Homo sapiens
  Payload ID: 1062;
  Gene Symbol: ANLN;
  Gene Name: anillin actin binding prt;
  ENSP ID: ENSP00000413522
  MOD_RES (1)..(1): Any amino acid
XQEHSKESPARSTPHRTPIITPNTKAIQERLFKQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRET

SEQ ID NO: 4844 - protein, 492 aa, Homo sapiens
  Payload ID: 1063;
  Gene Symbol: ANKH;
  Gene Name: ANKH inorganic pyrophosphate transport regulator;
  Uniprot ID:  Q9HCJ1;
  ENSP ID: ENSP00000284268
MVKFPALTHYWPLIRFLVPLGITNIAIDFGEQALNRGIAAVKEDAVEMLASYGLAYSLMKFFTGPMSDFKNVGLVFVNSKRDRTKAVLCMVVAGAIAAVFHTLIAYSDLGYYIINKLHHVDESVGSKTRRAFLYLAAFPFMDAMAWTHAGILLKHKYSFLVGCASISDVIAQVVFVAILLHSHLECREPLLIPILSLYMGALVRCTTLCLGYYKNIHDIIPDRSGPELGGDATIRKMLSFWWPLALILATQRISRPIVNLFVSRDLGGSSAATEAVAILTATYPVGHMPYGWLTEIRAVYPAFDKNNPSNKLVSTSNTVTAAHIKKFTFVCMALSLTLCFVMFWTPNVSEKILIDIIGVDFAFAELCVVPLRIFSFFPVPVTVRAHLTGWLMTLKKTFVLAPSSVLRIIVLIASLVVLPYLGVHGATLGVGSLLAGFVGESTMVAIAACYVYRKQKKKMENESATEGEDSAMTDMPPTEEVTDIVEMREENE

SEQ ID NO: 4845 - protein, 126 aa, Homo sapiens
  Payload ID: 1063;
  Gene Symbol: ANKH;
  Gene Name: ANKH inorganic pyrophosphate transport regulator;
  ENSP ID: ENSP00000426332
MVKFPALTHYWPLIRFLVPLGITNIAIDFGEQVSPGPAPHARSPCLGLTRPDTGAEGSHLLRVPLYPETFGRVCSLSRVTFPAPHSLPPSPQLFSRLFQPSLENVKKTGWCEASPMEGFLVHGSIM

SEQ ID NO: 4846 - protein, 636 aa, Homo sapiens
  Payload ID: 1064;
  Gene Symbol: ANKHD1-EIF4EBP3;
  Gene Name: ANKHD1-EIF4EBP3 readthrough;
  ENSP ID: ENSP00000396882
SSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMGLPISMYGGTIIPSHPQLADVPGGPLFNGLHNPDPAWNPMIKVIQNSTECTDAQQASLLPSVPALKGEIPSPQLTRPKKRIGRPMVASPNQRHQDHLRPKVPAGVQELTHCPDTPLLPPSDSRGHNSSNSPSLQAGGAEGAGDRGRDTR

SEQ ID NO: 4847 - protein, 2617 aa, Homo sapiens
  Payload ID: 1064;
  Gene Symbol: ANKHD1-EIF4EBP3;
  Gene Name: ANKHD1-EIF4EBP3 readthrough;
  ENSP ID: ENSP00000432016
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSSTSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQASLLPSVPALKGEIPSPQLTRPKKRIGRPMVASPNQRHQDHLRPKVPAGVQELTHCPDTPLLPPSDSRGHNSSNSPSLQAGGAEGAGDRGRDTR

SEQ ID NO: 4848 - protein, 1897 aa, Homo sapiens
  Payload ID: 1065;
  Gene Symbol: ANK1;
  Gene Name: ankyrin 1, erythrocytic;
  Uniprot ID:  P16157;
  ENSP ID: ENSP00000265709
MAQAAKQLKKIKDIEAQALQEQKEKEESNRKRRNRSRDRKKKADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGTAHITIMGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEDHTSTPNP

SEQ ID NO: 4849 - protein, 1880 aa, Homo sapiens
  Payload ID: 1065;
  Gene Symbol: ANK1;
  Gene Name: ankyrin 1, erythrocytic;
  Uniprot ID:  P16157;
  ENSP ID: ENSP00000289734
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 4850 - protein, 109 aa, Homo sapiens
  Payload ID: 1065;
  Gene Symbol: ANK1;
  Gene Name: ankyrin 1, erythrocytic;
  Uniprot ID:  P16157;
  ENSP ID: ENSP00000297744
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKDHTSTPNP

SEQ ID NO: 4851 - protein, 155 aa, Homo sapiens
  Payload ID: 1065;
  Gene Symbol: ANK1;
  Gene Name: ankyrin 1, erythrocytic;
  Uniprot ID:  P16157;
  ENSP ID: ENSP00000319123
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 4852 - protein, 113 aa, Homo sapiens
  Payload ID: 1065;
  Gene Symbol: ANK1;
  Gene Name: ankyrin 1, erythrocytic;
  ENSP ID: ENSP00000335031
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKVELRGSGLQPDL

SEQ ID NO: 4853 - protein, 1881 aa, Homo sapiens
  Payload ID: 1065;
  Gene Symbol: ANK1;
  Gene Name: ankyrin 1, erythrocytic;
  Uniprot ID:  P16157;
  ENSP ID: ENSP00000339620
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVTVEGPLEDPSELEVDIDYFMKHSKDHTSTPNP

SEQ ID NO: 4854 - protein, 177 aa, Homo sapiens
  Payload ID: 1065;
  Gene Symbol: ANK1;
  Gene Name: ankyrin 1, erythrocytic;
  ENSP ID: ENSP00000428315
  MOD_RES (1)..(1): Any amino acid
XEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGGRSEVRREAARF

SEQ ID NO: 4855 - protein, 131 aa, Homo sapiens
  Payload ID: 1065;
  Gene Symbol: ANK1;
  Gene Name: ankyrin 1, erythrocytic;
  ENSP ID: ENSP00000428750
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKIIRKVVRQIDLSSADAAQEHEEDHTSTPNP

SEQ ID NO: 4856 - protein, 1040 aa, Homo sapiens
  Payload ID: 1065;
  Gene Symbol: ANK1;
  Gene Name: ankyrin 1, erythrocytic;
  ENSP ID: ENSP00000430174
  MOD_RES (1)..(1): Any amino acid
XIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGTAHITIMGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 4857 - protein, 156 aa, Homo sapiens
  Payload ID: 1065;
  Gene Symbol: ANK1;
  Gene Name: ankyrin 1, erythrocytic;
  Uniprot ID:  P16157;
  ENSP ID: ENSP00000430368
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKIIRKVVRQIDLSSADAAQEHEEVTVEGPLEDPSELEVDIDYFMKHSKDHTSTPNP

SEQ ID NO: 4858 - protein, 3924 aa, Homo sapiens
  Payload ID: 1066;
  Gene Symbol: ANK2;
  Gene Name: ankyrin 2, neuronal;
  ENSP ID: ENSP00000264366
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQKEEGLQASAEKAELKKGSSEESLGEDPGLAPEPLPTVKATSPLIEETPIGSIKDKVKALQKRVEDEQKGRSKLPIRVKGKEDVPKKTTHRPHPAASPSLKSERHAPGSPSPKTERHSTLSSSAKTERHPPVSPSSKTEKHSPVSPSAKTERHSPASSSSKTEKHSPVSPSTKTERHSPVSSTKTERHPPVSPSGKTDKRPPVSPSGRTEKHPPVSPGRTEKRLPVSPSGRTDKHQPVSTAGKTEKHLPVSPSGKTEKQPPVSPTSKTERIEETMSVRELMKAFQSGQDPSKHKTGLFEHKSAKQKQPQEKGKVRVEKEKGPILTQREAQKTENQTIKRGQRLPVTGTAESKRGVRVSSIGVKKEDAAGGKEKVLSHKIPEPVQSVPEEESHRESEVPKEKMADEQGDMDLQISPDRKTSTDFSEVIKQELEDNDKYQQFRLSEETEKAQLHLDQVLTSPFNTTFPLDYMKDEFLPALSLQSGALDGSSESLKNEGVAGSPCGSLMEGTPQISSEESYKHEGLAETPETSPESLSFSPKKSEEQTGETKESTKTETTTEIRSEKEHPTTKDITGGSEERGATVTEDSETSTESFQKEATLGSPKDTSPKRQDDCTGSCSVALAKETPTGLTEEAACDEGQRTFGSSAHKTQTDSEVQESTATSDETKALPLPEASVKTDTGTESKPQGVIRSPQGLELALPSRDSEVLSAVADDSLAVSHKDSLEASPVLEDNSSHKTPDSLEPSPLKESPCRDSLESSPVEPKMKAGIFPSHFPLPAAVAKTELLTEVASVRSRLLRDPDGSAEDDSLEQTSLMESSGKSPLSPDTPSSEEVSYEVTPKTTDVSTPKPAVIHECAEEDDSENGEKKRFTPEEEMFKMVTKIKMFDELEQEAKQKRDYKKEPKQEESSSSSDPDADCSVDVDEPKHTGSGEDESGVPVLVTSESRKVSSSSESEPELAQLKKGADSGLLPEPVIRVQPPSPLPSSMDSNSSPEEVQFQPVVSKQYTFKMNEDTQEEPGKSEEEKDSESHLAEDRHAVSTEAEDRSYDKLNRDTDQPKICDGHGCEAMSPSSSAAPVSSGLQSPTGDDVDEQPVIYKESLALQGTHEKDTEGEELDVSRAESPQADCPSESFSSSSSLPHCLVSEGKELDEDISATSSIQKTEVTKTDETFENLPKDCPSQDSSITTQTDRFSMDVPVSDLAENDEIYDPQITSPYENVPSQSFFSSEESKTQTDANHTTSFHSSEVYSVTITSPVEDVVVASSSSGTVLSKESNFEGQDIKMESQQESTLWEMQSDSVSSSFEPTMSATTTVVGEQISKVIITKTDVDSDSWSEIREDDEAFEARVKEEEQKIFGLMVDRQSQGTTPDTTPARTPTEEGTPTSEQNPFLFQEGKLFEMTRSGAIDMTKRSYADESFHFFQIGQESREETLSEDVKEGATGADPLPLETSAESLALSESKETVDDEADLLPDDVSEEVEEIPASDAQLNSQMGISASTETPTKEAVSVGTKDLPTVQTGDIPPLSGVKQISCPDSSEPAVQVQLDFSTLTRSVYSDRGDDSPDSSPEEQKSVIEIPTAPMENVPFTESKSKIPVRTMPTSTPAPPSAEYESSVSEDFLSSVDEENKADEAKPKSKLPVKVPLQRVEQQLSDLDTSVQKTVAPQGQDMASIAPDNRSKSESDASSLDSKTKCPVKTRSYTETETESRERAEELELESEEGATRPKILTSRLPVKSRSTTSSCRGGTSPTKESKEHFFDLYRNSIEFFEEISDEASKLVDRLTQSEREQEIVSDDESSSALEVSVIENLPPVETEHSVPEDIFDTRPIWDESIETLIERIPDENGHDHAEDPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 4859 - protein, 3957 aa, Homo sapiens
  Payload ID: 1066;
  Gene Symbol: ANK2;
  Gene Name: ankyrin 2, neuronal;
  Uniprot ID:  Q01484;
  ENSP ID: ENSP00000349588
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQKEEGLQASAEKAELKKGSSEESLGEDPGLAPEPLPTVKATSPLIEETPIGSIKDKVKALQKRVEDEQKGRSKLPIRVKGKEDVPKKTTHRPHPAASPSLKSERHAPGSPSPKTERHSTLSSSAKTERHPPVSPSSKTEKHSPVSPSAKTERHSPASSSSKTEKHSPVSPSTKTERHSPVSSTKTERHPPVSPSGKTDKRPPVSPSGRTEKHPPVSPGRTEKRLPVSPSGRTDKHQPVSTAGKTEKHLPVSPSGKTEKQPPVSPTSKTERIEETMSVRELMKAFQSGQDPSKHKTGLFEHKSAKQKQPQEKGKVRVEKEKGPILTQREAQKTENQTIKRGQRLPVTGTAESKRGVRVSSIGVKKEDAAGGKEKVLSHKIPEPVQSVPEEESHRESEVPKEKMADEQGDMDLQISPDRKTSTDFSEVIKQELEDNDKYQQFRLSEETEKAQLHLDQVLTSPFNTTFPLDYMKDEFLPALSLQSGALDGSSESLKNEGVAGSPCGSLMEGTPQISSEESYKHEGLAETPETSPESLSFSPKKSEEQTGETKESTKTETTTEIRSEKEHPTTKDITGGSEERGATVTEDSETSTESFQKEATLGSPKDTSPKRQDDCTGSCSVALAKETPTGLTEEAACDEGQRTFGSSAHKTQTDSEVQESTATSDETKALPLPEASVKTDTGTESKPQGVIRSPQGLELALPSRDSEVLSAVADDSLAVSHKDSLEASPVLEDNSSHKTPDSLEPSPLKESPCRDSLESSPVEPKMKAGIFPSHFPLPAAVAKTELLTEVASVRSRLLRDPDGSAEDDSLEQTSLMESSGKSPLSPDTPSSEEVSYEVTPKTTDVSTPKPAVIHECAEEDDSENGEKKRFTPEEEMFKMVTKIKMFDELEQEAKQKRDYKKEPKQEESSSSSDPDADCSVDVDEPKHTGSGEDESGVPVLVTSESRKVSSSSESEPELAQLKKGADSGLLPEPVIRVQPPSPLPSSMDSNSSPEEVQFQPVVSKQYTFKMNEDTQEEPGKSEEEKDSESHLAEDRHAVSTEAEDRSYDKLNRDTDQPKICDGHGCEAMSPSSSAAPVSSGLQSPTGDDVDEQPVIYKESLALQGTHEKDTEGEELDVSRAESPQADCPSESFSSSSSLPHCLVSEGKELDEDISATSSIQKTEVTKTDETFENLPKDCPSQDSSITTQTDRFSMDVPVSDLAENDEIYDPQITSPYENVPSQSFFSSEESKTQTDANHTTSFHSSEVYSVTITSPVEDVVVASSSSGTVLSKESNFEGQDIKMESQQESTLWEMQSDSVSSSFEPTMSATTTVVGEQISKVIITKTDVDSDSWSEIREDDEAFEARVKEEEQKIFGLMVDRQSQGTTPDTTPARTPTEEGTPTSEQNPFLFQEGKLFEMTRSGAIDMTKRSYADESFHFFQIGQESREETLSEDVKEGATGADPLPLETSAESLALSESKETVDDEADLLPDDVSEEVEEIPASDAQLNSQMGISASTETPTKEAVSVGTKDLPTVQTGDIPPLSGVKQISCPDSSEPAVQVQLDFSTLTRSVYSDRGDDSPDSSPEEQKSVIEIPTAPMENVPFTESKSKIPVRTMPTSTPAPPSAEYESSVSEDFLSSVDEENKADEAKPKSKLPVKVPLQRVEQQLSDLDTSVQKTVAPQGQDMASIAPDNRSKSESDASSLDSKTKCPVKTRSYTETETESRERAEELELESEEGATRPKILTSRLPVKSRSTTSSCRGGTSPTKESKEHFFDLYRNSIEFFEEISDEASKLVDRLTQSEREQEIVSDDESSSALEVSVIENLPPVETEHSVPEDIFDTRPIWDESIETLIERIPDENGHDHAEDPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 4860 - protein, 1872 aa, Homo sapiens
  Payload ID: 1066;
  Gene Symbol: ANK2;
  Gene Name: ankyrin 2, neuronal;
  Uniprot ID:  Q01484;
  ENSP ID: ENSP00000378044
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 4861 - protein, 1611 aa, Homo sapiens
  Payload ID: 1066;
  Gene Symbol: ANK2;
  Gene Name: ankyrin 2, neuronal;
  ENSP ID: ENSP00000421011
MTTMLQKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSL

SEQ ID NO: 4862 - protein, 555 aa, Homo sapiens
  Payload ID: 1066;
  Gene Symbol: ANK2;
  Gene Name: ankyrin 2, neuronal;
  Uniprot ID:  Q01484;
  ENSP ID: ENSP00000421023
MTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKELTEELGELEASSDEEAMVTTRVVRRRVIIQGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 4863 - protein, 65 aa, Homo sapiens
  Payload ID: 1066;
  Gene Symbol: ANK2;
  Gene Name: ankyrin 2, neuronal;
  ENSP ID: ENSP00000421059
MAAQENHIDVVKYLLENGANQSTATEDGFTPLAVALQQGHNQAVAILLENDTKGKVRLPALHIAA

SEQ ID NO: 4864 - protein, 1863 aa, Homo sapiens
  Payload ID: 1066;
  Gene Symbol: ANK2;
  Gene Name: ankyrin 2, neuronal;
  Uniprot ID:  Q01484;
  ENSP ID: ENSP00000421067
MTTMLQKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGRASPCLERDNSSFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 4865 - protein, 81 aa, Homo sapiens
  Payload ID: 1066;
  Gene Symbol: ANK2;
  Gene Name: ankyrin 2, neuronal;
  ENSP ID: ENSP00000422486
  MOD_RES (1)..(1): Any amino acid
XPQEPVNIEEGDGYSKVIKRVVLKSDTEQSEALSYTGSHMKVHLPSLVENEILKEDGSIIKRTTMSKAITQKRAVVKDQHG

SEQ ID NO: 4866 - protein, 1028 aa, Homo sapiens
  Payload ID: 1066;
  Gene Symbol: ANK2;
  Gene Name: ankyrin 2, neuronal;
  ENSP ID: ENSP00000422498
QDIKMESQQESTLWEMQSDSVSSSFEPTMSATTTVVGEQISKVIITKTDVDSDSWSEIREDDEAFEARVKEEEQKIFGLMVDRQSQGTTPDTTPARTPTEEGTPTSEQNPFLFQEGKLFEMTRSGAIDMTKRSYADESFHFFQIGQESREETLSEDVKEGATGADPLPLETSAESLALSESKETVDDEADLLPDDVSEEVEEIPASDAQLNSQMGISASTETPTKEAVSVGTKDLPTVQTGDIPPLSGVKQISCPDSSEPAVQVQLDFSTLTRSVYSDRGDDSPDSSPEEQKSVIEIPTAPMENVPFTESKSKIPVRTMPTSTPAPPSAEYESSVSEDFLSSVDEENKADEAKPKSKLPVKVPLQRVEQQLSDLDTSVQKTVAPQGQDMASIAPDNRSKSESDASSLDSKTKCPVKTRSYTETETESRERAEELELESEEGATRPKILTSRLPVKSRSTTSSCRGGTSPTKESKEHFFDLYRNSIEFFEEISDEASKLVDRLTQSEREQEIVSDDESSSALEVSVIENLPPVETEHSVPEDIFDTRPIWDESIETLIERIPDENGHDHAEDPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEVTLCEPSILSSTSQFQAEPVEGRRVSKVVKTTVVLGERMEKHLGDSSLATDLPSAKDDFEEDNNE

SEQ ID NO: 4867 - protein, 966 aa, Homo sapiens
  Payload ID: 1066;
  Gene Symbol: ANK2;
  Gene Name: ankyrin 2, neuronal;
  ENSP ID: ENSP00000422853
  MOD_RES (1)..(1): Any amino acid
XNVALSSSPIHSGFLVSFMVDARGGAMRGCRHNGLRIIIPPRKCTAPTRVTCRLVKRHRLATMPPMVEGEGLASRLIEVGPSGAQFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKIDMTSEKNPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKELTEELGELEASSDEEAMVTTRVVRRRVIIQGDDMPEIPPETVTEEEYIDEHGHTVVKKVTRKIIRRYVSSEGTEKEEIMVQGMPQEPVNIEEGDGYSKVIKRVVLKSDTEQSEVTLCEPSILSSTSQFQAEPVEGRRVSKVVKTTVVLGERMEKHLGDSSLATDLPSAKDDFEEDNNE

SEQ ID NO: 4868 - protein, 197 aa, Homo sapiens
  Payload ID: 1066;
  Gene Symbol: ANK2;
  Gene Name: ankyrin 2, neuronal;
  ENSP ID: ENSP00000422888
  MOD_RES (1)..(1): Any amino acid
XSEGTEKEEIMVQGMPQEPVNIEEGDGYSKVIKRVVLKSDTEQSEVTLCEPSILSSTSQFQAEPVEGRRVSKVVKTTVVLGERMEKHLGDSSLATDLPSAKDDFEEALSYTGSHMKVHLPSLVENEILKEDGSIIKRTTMSKAITQKRAVVKDQHGKRIDLEHLEDVPEALDQDDLQRDLQQLLRHFCKEDLKQEAK

SEQ ID NO: 4869 - protein, 177 aa, Homo sapiens
  Payload ID: 1066;
  Gene Symbol: ANK2;
  Gene Name: ankyrin 2, neuronal;
  ENSP ID: ENSP00000422900
MAHAAASIKKVREADLDEKEKNLERDRKKQRKIPRERMERKRKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATED

SEQ ID NO: 4870 - protein, 1114 aa, Homo sapiens
  Payload ID: 1066;
  Gene Symbol: ANK2;
  Gene Name: ankyrin 2, neuronal;
  ENSP ID: ENSP00000423799
MTTMLQKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLE

SEQ ID NO: 4871 - protein, 1730 aa, Homo sapiens
  Payload ID: 1066;
  Gene Symbol: ANK2;
  Gene Name: ankyrin 2, neuronal;
  ENSP ID: ENSP00000424722
MMNEDAAQKSDSGEKFNGSSQRRKRPKKVTCPQMKPEAANIEKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQK

SEQ ID NO: 4872 - protein, 112 aa, Homo sapiens
  Payload ID: 1066;
  Gene Symbol: ANK2;
  Gene Name: ankyrin 2, neuronal;
  ENSP ID: ENSP00000425775
MGNAALCSSCHADKSIRAQGNMQELDKTPDYYGCNSEDVKEPGVWSDSNASFLRAARAGNLDKVVEYLKGGIDINTCNQNGLNALHLAAKEGHVGLVQELLGRGSSVDSATK

SEQ ID NO: 4873 - protein, 1048 aa, Homo sapiens
  Payload ID: 1066;
  Gene Symbol: ANK2;
  Gene Name: ankyrin 2, neuronal;
  ENSP ID: ENSP00000426944
MNGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 4874 - protein, 187 aa, Homo sapiens
  Payload ID: 1066;
  Gene Symbol: ANK2;
  Gene Name: ankyrin 2, neuronal;
  ENSP ID: ENSP00000426994
  MOD_RES (1)..(1): Any amino acid
XIQESVTFASQVYREIICVPYMAKFVVFAKSHDPIEARLRCFCMTDDKVDKTLEQQENFAEVARSRDVEVRDTTQEPCGRLSFMKEPKSTRGLVHQAICNLNITLPIYTKESESDQEQEEEIDMTSEKNPQDEQERIEERLAYIADHLGFSWTELARELDFTEEQIHQIRIENPNSLQDQSHALLKY

SEQ ID NO: 4875 - protein, 180 aa, Homo sapiens [sequence omitted]

SEQ ID NO: 4876 - protein, 1194 aa, Homo sapiens
  Payload ID: 1066;
  Gene Symbol: ANK2;
  Gene Name: ankyrin 2, neuronal;
  ENSP ID: ENSP00000489091
SDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSTMPSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLE

SEQ ID NO: 4877 - protein, 4377 aa, Homo sapiens
  Payload ID: 1067;
  Gene Symbol: ANK3;
  Gene Name: ankyrin 3, node of Ranvier (ankyrin G);
  Uniprot ID:  Q12955;
  ENSP ID: ENSP00000280772
MAHAASQLKKNRDLEINAEEEPEKKRKHRKRSRDRKKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKETESDQDDEIEKTDRRQSFASLALRKRYSYLTEPGMIERSTGATRSLPTTYSYKPFFSTRPYQSWTTAPITVPGPAKSGFTSLSSSSSNTPSASPLKSIWSVSTPSPIKSTLGASTTSSVKSISDVASPIRSFRTMSSPIKTVVSQSPYNIQVSSGTLARAPAVTEATPLKGLASNSTFSSRTSPVTTAGSLLERSSITMTPPASPKSNINMYSSSLPFKSIITSAAPLISSPLKSVVSPVKSAVDVISSAKITMASSLSSPVKQMPGHAEVALVNGSISPLKYPSSSTLINGCKATATLQEKISSATNSVSSVVSAATDTVEKVFSTTTAMPFSPLRSYVSAAPSAFQSLRTPSASALYTSLGSSISATTSSVTSSIITVPVYSVVNVLPEPALKKLPDSNSFTKSAAALLSPIKTLTTETHPQPHFSRTSSPVKSSLFLAPSALKLSTPSSLSSSQEILKDVAEMKEDLMRMTAILQTDVPEEKPFQPELPKEGRIDDEEPFKIVEKVKEDLVKVSEILKKDVCVDNKGSPKSPKSDKGHSPEDDWIEFSSEEIREARQQAAASQSPSLPERVQVKAKAASEKDYNLTKVIDYLTNDIGSSSLTNLKYKFEDAKKDGEERQKRVLKPAIALQEHKLKMPPASMRTSTSEKELCKMADSFFGTDTILESPDDFSQHDQDKSPLSDSGFETRSEKTPSAPQSAESTGPKPLFHEVPIPPVITETRTEVVHVIRSYDPSAGDVPQTQPEEPVSPKPSPTFMELEPKPTTSSIKEKVKAFQMKASSEEDDHNRVLSKGMRVKEETHITTTTRMVYHSPPGGEGASERIEETMSVHDIMKAFQSGRDPSKELAGLFEHKSAVSPDVHKSAAETSAQHAEKDNQMKPKLERIIEVHIEKGNQAEPTEVIIRETKKHPEKEMYVYQKDLSRGDINLKDFLPEKHDAFPCSEEQGQQEEEELTAEESLPSYLESSRVNTPVSQEEDSRPSSAQLISDDSYKTLKLLSQHSIEYHDDELSELRGESYRFAEKMLLSEKLDVSHSDTEESVTDHAGPPSSELQGSDKRSREKIATAPKKEILSKIYKDVSENGVGKVSKDEHFDKVTVLHYSGNVSSPKHAMWMRFTEDRLDRGREKLIYEDRVDRTVKEAEEKLTEVSQFFRDKTEKLNDELQSPEKKARPKNGKEYSSQSPTSSSPEKVLLTELLASNDEWVKARQHGPDGQGFPKAEEKAPSLPSSPEKMVLSQQTEDSKSTVEAKGSISQSKAPDGPQSGFQLKQSKLSSIRLKFEQGTHAKSKDMSQEDRKSDGQSRIPVKKIQESKLPVYQVFAREKQQKAIDLPDESVSVQKDFMVLKTKDEHAQSNEIVVNDSGSDNVKKQRTEMSSKAMPDSFSEQQAKDLACHITSDLATRGPWDKKVFRTWESSGATNNKSQKEKLSHVLVHDVRENHIGHPESKSVDQKNEFMSVTERERKLLTNGSLSEIKEMTVKSPSKKVLYREYVVKEGDHPGGLLDQPSRRSESSAVSHIPVRVADERRMLSSNIPDGFCEQSAFPKHELSQKLSQSSMSKETVETQHFNSIEDEKVTYSEISKVSKHQSYVGLCPPLEETETSPTKSPDSLEFSPGKESPSSDVFDHSPIDGLEKLAPLAQTEGGKEIKTLPVYVSFVQVGKQYEKEIQQGGVKKIISQECKTVQETRGTFYTTRQQKQPPSPQGSPEDDTLEQVSFLDSSGKSPLTPETPSSEEVSYEFTSKTPDSLIAYIPGKPSPIPEVSEESEEEEQAKSTSLKQTTVEETAVEREMPNDVSKDSNQRPKNNRVAYIEFPPPPPLDADQIESDKKHHYLPEKEVDMIEVNLQDEHDKYQLAEPVIRVQPPSPVPPGADVSDSSDDESIYQPVPVKKYTFKLKEVDDEQKEKPKASAEKASNQKELESNGSGKDNEFGLGLDSPQNEIAQNGNNDQSITECSIATTAEFSHDTDATEIDSLDGYDLQDEDDGLTESDSKLPIQAMEIKKDIWNTEGILKPADRSFSQSKLEVIEEEGKVGPDEDKPPSKSSSSEKTPDKTDQKSGAQFFTLEGRHPDRSVFPDTYFSYKVDEEFATPFKTVATKGLDFDPWSNNRGDDEVFDSKSREDETKPFGLAVEDRSPATTPDTTPARTPTDESTPTSEPNPFPFHEGKMFEMTRSGAIDMSKRDFVEERLQFFQIGEHTSEGKSGDQGEGDKSMVTATPQPQSGDTTVETNLERNVETPTVEPNPSIPTSGECQEGTSSSGSLEKSAAATNTSKVDPKLRTPIKMGISASTMTMKKEGPGEITDKIEAVMTSCQGLENETITMISNTANSQMGVRPHEKHDFQKDNFNNNNNLDSSTIQTDNIMSNIVLTEHSAPTCTTEKDNPVKVSSGKKTGVLQGHCVRDKQKVLGEQQKTKELIGIRQKSKLPIKATSPKDTFPPNHMSNTKASKMKQVSQSEKTKALTTSSCVDVKSRIPVKNTHRDNIIAVRKACATQKQGQPEKGKAKQLPSKLPVKVRSTCVTTTTTTATTTTTTTTTTTTSCTVKVRKSQLKEVCKHSIEYFKGISGETLKLVDRLSEEEKKMQSELSDEEESTSRNTSLSETSRGGQPSVTTKSARDKKTEAAPLKSKSEKAGSEKRSSRRTGPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 4878 - protein, 1001 aa, Homo sapiens
  Payload ID: 1067;
  Gene Symbol: ANK3;
  Gene Name: ankyrin 3, node of Ranvier (ankyrin G);
  Uniprot ID:  Q12955;
  ENSP ID: ENSP00000347436
MALPQSEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 4879 - protein, 195 aa, Homo sapiens
  Payload ID: 1067;
  Gene Symbol: ANK3;
  Gene Name: ankyrin 3, node of Ranvier (ankyrin G);
  ENSP ID: ENSP00000362921
MTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSM

SEQ ID NO: 4880 - protein, 459 aa, Homo sapiens
  Payload ID: 1067;
  Gene Symbol: ANK3;
  Gene Name: ankyrin 3, node of Ranvier (ankyrin G);
  ENSP ID: ENSP00000362926
PKTTKGLPQTAVCNLNITLPAHKKETESDQDDEIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 4881 - protein, 1861 aa, Homo sapiens
  Payload ID: 1067;
  Gene Symbol: ANK3;
  Gene Name: ankyrin 3, node of Ranvier (ankyrin G);
  Uniprot ID:  Q12955;
  ENSP ID: ENSP00000362933
MASSASSSPAGTEDSAPAQGGFGSDYSRSSRKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 4882 - protein, 72 aa, Homo sapiens
  Payload ID: 1067;
  Gene Symbol: ANK3;
  Gene Name: ankyrin 3, node of Ranvier (ankyrin G);
  ENSP ID: ENSP00000422506
MTGDTDKYLGPQDLKELGDDSLPAEGYMGFSLGARSASLRSFSSDRSYTLNRSSYARDSMMIEELLVPSKEQ

SEQ ID NO: 4883 - protein, 114 aa, Homo sapiens
  Payload ID: 1067;
  Gene Symbol: ANK3;
  Gene Name: ankyrin 3, node of Ranvier (ankyrin G);
  ENSP ID: ENSP00000422657
TVTEKHKMNVPETMNEVLDMSDDEVRKANAPEMLSDGEYISDVEEGNRCTWYKIPKVQEFTVKSEDAMTGDTDKYLGPQDLKELGDDSLPAEGYMGFSLGARSARYFVVAVFHS

SEQ ID NO: 4884 - protein, 166 aa, Homo sapiens
  Payload ID: 1067;
  Gene Symbol: ANK3;
  Gene Name: ankyrin 3, node of Ranvier (ankyrin G);
  ENSP ID: ENSP00000423057
SPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKVKSPGAAPTRMTACCYKQGEGFKVKTKKEIRHVEKKSHS

SEQ ID NO: 4885 - protein, 196 aa, Homo sapiens
  Payload ID: 1067;
  Gene Symbol: ANK3;
  Gene Name: ankyrin 3, node of Ranvier (ankyrin G);
  ENSP ID: ENSP00000423968
  MOD_RES (1)..(1): Any amino acid
XSSPIHSGFLVSFMVDARGGSMRGSRHHGMRIIIPPRKCTAPTRITCRLVKRHKLANPPPMVEGEGLASRLVEMGPAGAQFLGKLHLPTNPPPVNEGESLVSRILQLGPQGTKFIGPVIVEIPHFGSMRGKERELIVLRSENGETWKEHQFDSKNEDLTELLNGMDEELDSPEELGKKRICRIITKDFPQYFAVVS

SEQ ID NO: 4886 - protein, 1868 aa, Homo sapiens
  Payload ID: 1067;
  Gene Symbol: ANK3;
  Gene Name: ankyrin 3, node of Ranvier (ankyrin G);
  Uniprot ID:  Q12955;
  ENSP ID: ENSP00000425236
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGNRCTWYKIPKVQEFTVKSEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 4887 - protein, 273 aa, Homo sapiens
  Payload ID: 1067;
  Gene Symbol: ANK3;
  Gene Name: ankyrin 3, node of Ranvier (ankyrin G);
  ENSP ID: ENSP00000426011
MAVEEGESFPEQSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTR

SEQ ID NO: 4888 - protein, 187 aa, Homo sapiens
  Payload ID: 1067;
  Gene Symbol: ANK3;
  Gene Name: ankyrin 3, node of Ranvier (ankyrin G);
  ENSP ID: ENSP00000426258
  MOD_RES (1)..(1): Any amino acid
XIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDDGPPVVTAEDASLEDSKLEDSVPLTEMPEAVDVDESQLENVC

SEQ ID NO: 4889 - protein, 159 aa, Homo sapiens
  Payload ID: 1067;
  Gene Symbol: ANK3;
  Gene Name: ankyrin 3, node of Ranvier (ankyrin G);
  ENSP ID: ENSP00000426582
MTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPP

SEQ ID NO: 4890 - protein, 86 aa, Homo sapiens
  Payload ID: 1067;
  Gene Symbol: ANK3;
  Gene Name: ankyrin 3, node of Ranvier (ankyrin G);
  ENSP ID: ENSP00000426690
MNVPETMNEVLDMSDDEGNRCTWYKIPKVQEFTVKSEDAMTGDTDKYLGPQDLKELGDDSLPAEGYMGFSLGARSARYFVVAVFHS

SEQ ID NO: 4891 - protein, 217 aa, Homo sapiens
  Payload ID: 1067;
  Gene Symbol: ANK3;
  Gene Name: ankyrin 3, node of Ranvier (ankyrin G);
  ENSP ID: ENSP00000427121
  MOD_RES (1)..(1): Any amino acid
XLARELNFSVDEINQIRVENPNSLISQSFMLLKKWVTRDGKNATTDALTSVLTKINRIDIVTLLEGPIFDYGNISGTRSFADENNVFHDPVDVSPNVLSSIGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLES

SEQ ID NO: 4892 - protein, 241 aa, Homo sapiens
  Payload ID: 1067;
  Gene Symbol: ANK3;
  Gene Name: ankyrin 3, node of Ranvier (ankyrin G);
  ENSP ID: ENSP00000477814
  MOD_RES (1)..(1): Any amino acid
XTVATKGLDFDPWSNNRGDDEVFDSKSREDETKPFGLAVEDRSPATTPDTTPARTPTDESTPTSEPNPFPFHEGKMFEMTRSGAIDMSKRDFVEERLQFFQIGPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTP

SEQ ID NO: 4893 - protein, 1643 aa, Homo sapiens
  Payload ID: 1067;
  Gene Symbol: ANK3;
  Gene Name: ankyrin 3, node of Ranvier (ankyrin G);
  ENSP ID: ENSP00000477827
  MOD_RES (1)..(1): Any amino acid
XFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMKTVERSTGATRSLPTTYSYKPFFSTRPYQSWTTAPITVPGPAKSGFTSLSSSSSNTPSASPLKSIWSVSTPSPIKSTLGASTTSSVKSISDVASPIRSFRTMSSPIKTVVSQSPYNIQVSSGTLARAPAVTEATPLKGLASNSTFSSRTSPVTTAGSLLERSSITMTPPASPKSNINMYSSSLPFKSIITSAAPLISSPLKSVVSPVKSAVDVISSAKITMASSLSSPVKQMPGHAEVALVNGSISPLKYPSSSTLINGCKATATLQEKISSATNSVSSVVSAATDTVEKVFSTTTAMPFSPLRSYVSAAPSAFQSLRTPSASALYTSLGSSISATTSSVTSSIITVPVYSVVNVLPEPALKKLPDSNSFTKSAAALLSPIKTLTTETHPQPHFSRTSSPVKSSLFLAPSALKLSTPSSLSSSQEILKDVAEMKEDLMRMTAILQTDVPEEKPFQPELPKEGRIDDEEPFKIVEKVKEDLVKVSEILKKDVCVDNKGSPKSPKSDKGHSPEDDWIEFSSEEIREARQQAAASQSPSLPERVQVKAKAASEKDYNLTKVIDYLTNDIGSSSLTNLKYKFEDAKKDGEERQKRVLKPAIALQEHKLKMPPASMRTSTSEKELCKMADSFFGTDTILESPDDFSQHDQDKSPLSDSGFETRSEKTPSAPQSAESTGPKPLFHEVPIPPVITETRTEVVHVIRSYDPSAGDVPQTQPEEPVSPKPSPTFMELEPKPTTSSIKEKVKAFQMKASSEEDDHNRVLSKGMRVKEETHITTTTRMVYHSPPGGEGASERIEETMSVHDIMKAFQSGRDPSKELAGLFEHKSAVSPDVHKSAAETSAQHAEKDNQMKPKLERIIEVHIEKGPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 4894 - protein, 868 aa, Homo sapiens
  Payload ID: 1067;
  Gene Symbol: ANK3;
  Gene Name: ankyrin 3, node of Ranvier (ankyrin G);
  ENSP ID: ENSP00000478037
  MOD_RES (1)..(1): Any amino acid
XDLPDESVSVQKDFMVLKTKDEHAQSNEIVVNDSGSDNVKKQRTEMSSKAMPDSFSEQQAKDLACHITSDLATRGPWDKKVFRTWESSGATNNKSQKEKLSHVLVHDVRENHIGHPESKSVDQKNEFMSVTERERKLLTNGSLSEIKEMTVKSPSKKVLYREYVVKEGDHPGGLLDQPSRRSESSAVSHIPVRVADERRMLSSNIPDGFCEQSAFPKHELSQKLSQSSMSKETVETQHFNSIEDEKVTYSEISKVSKHQSYVGLCPPLEETETSPTKSPDSLEFSPGKESPSSDVFDHSPIDGLEKLAPLAQTEGGKEIKTLPVYVSFVQVGKQYEKEIQQGGVKKIISQECKTVQETRGTFYTTRQQKQPPSPQGSPEDDTLEQVSFLDSSGKSPLTPETPSSEEVSYEFTSKTPDSLIAYIPGKPSPIPEVSEESEEEEQAKSTSLKQTTVEETAVEREMPNDVSKDSNQRPKNNRVAYIEFPPPPPLDADQIESDKKHHYLPEKEVDMIEVNLQDEHDKYQLAEPVIRVQPPSPVPPGADVSDSSDDESIYQPVPVKKYTFKLKEVDDEQKEKPKASAEKASNQKELESNGSGKDNEFGLGLDSPQNEIAQNGNNDQSITECSIATTAEFSHDTDATEIDSLDGYDLQDEDDGLTESDSKLPIQAMEIKKDIWNTEGILKPADRSFSQSKLEVIEEEGKVGPDEDKPPSKSSSSEKTPDKTDQKSGAQFFTLEGRHPDRSVFPDTYFSYKVDEEFATPFKTVATKGLDFDPWSNNRGDDEVFDSKSREDETKPFGLAVEDRSPATTPDTTPARTPTDESTPTSEPNPFPFHEGKMFEMTRSGAIDMSKRDFVEERLQFFQIVVRP

SEQ ID NO: 4895 - protein, 811 aa, Homo sapiens
  Payload ID: 1067;
  Gene Symbol: ANK3;
  Gene Name: ankyrin 3, node of Ranvier (ankyrin G);
  ENSP ID: ENSP00000479018
MALPQSEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVM

SEQ ID NO: 4896 - protein, 322 aa, Homo sapiens
  Payload ID: 1067;
  Gene Symbol: ANK3;
  Gene Name: ankyrin 3, node of Ranvier (ankyrin G);
  ENSP ID: ENSP00000479337
  MOD_RES (1)..(1): Any amino acid
XGPDEDKPPSKSSSSEKTPDKTDQKSGAQFFTLEGRHPDRSVFPDTYFSYKVDEEFATPFKTVATKGLDFDPWSNNRGDDEVFDSKSREDETKPFGLAVEDRSPATTPDTTPARTPTDESTPTSEPNPFPFHEGKMFEMTRSGAIDMSKRDFVEERLQFFQIGPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGWQNETSSGNLESCAQARRVTGGLLDRLDDSPDQCRDSITSYL

SEQ ID NO: 4897 - protein, 96 aa, Homo sapiens
  Payload ID: 1067;
  Gene Symbol: ANK3;
  Gene Name: ankyrin 3, node of Ranvier (ankyrin G);
  ENSP ID: ENSP00000480249
  MOD_RES (1)..(1): Any amino acid
XLARELNFSVDEINQIRVENPNSLISQSFMLLKKWVTRDGKNATTDALTSVLTKINRIDIVTLLEGPIFDYGNISGTRSFADENNVFHDPVDGNRI

SEQ ID NO: 4898 - protein, 175 aa, Homo sapiens
  Payload ID: 1067;
  Gene Symbol: ANK3;
  Gene Name: ankyrin 3, node of Ranvier (ankyrin G);
  ENSP ID: ENSP00000480745
  MOD_RES (1)..(1): Any amino acid
XSPLAAYQKSLEETSKLIIEETKPCVPVSMKKMSRTSPADGKPRLSLHEEEGSSGSEQKVKSPGAAPTRMTACCYKDLKDSESDSSSEEERRVTTRVIRRRLIIKGEEAKNIPGESVTEEQFTDEEGNLITRKITRKVLRRIVIPQERKRDDVQGEGFKVKTKKEIRHVEKKSHS

SEQ ID NO: 4899 - protein, 178 aa, Homo sapiens
  Payload ID: 1067;
  Gene Symbol: ANK3;
  Gene Name: ankyrin 3, node of Ranvier (ankyrin G);
  ENSP ID: ENSP00000481611
  MOD_RES (1)..(1): Any amino acid
XWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKGEGFKVKTKKEIRHVEKKSHS

SEQ ID NO: 4900 - protein, 201 aa, Homo sapiens
  Payload ID: 1067;
  Gene Symbol: ANK3;
  Gene Name: ankyrin 3, node of Ranvier (ankyrin G);
  ENSP ID: ENSP00000482307
  MOD_RES (1)..(1): Any amino acid
XEDAMTGDTDKYLGPQDLKELGDDSLPAEGYMGFSLGARSASPKISLRSFSSDRSYTLNRSSYARDSMMIEELLVPSKEQHLTFTREFDSDSLRHYSWAADTLDNVNLVSSPIHSGYSSPLPQYDSRFLVSFMVDARGGSMRGSRHHGMRIIIPPRKCTAPTRITCRLVKRHKLANPPPMVEGEGLASRLVEMGPAGAQFL

SEQ ID NO: 4901 - protein, 973 aa, Homo sapiens
  Payload ID: 1067;
  Gene Symbol: ANK3;
  Gene Name: ankyrin 3, node of Ranvier (ankyrin G);
  ENSP ID: ENSP00000482401
  MOD_RES (1)..(1): Any amino acid
XPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKETESDQDDEIEKTDRRQSFASLALRPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSEYPQYLGNLAGSPKDVKPAEPRKLGVSSEQQEKGKSGPDEEMMEEKLKSLFEDIQLEEGVESEEMTEEKVQAILKRVQQAELEMSSITGWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKDLKDSESDSSSEEERRVTTRVIRRRLIIKGEEAKNIPGESVTEEQFTDEEGNLITRKITRKVLRRIVIPQERKRDDVQGEGFKVKTKKEIRHVEKKSHS

SEQ ID NO: 4902 - protein, 450 aa, Homo sapiens
  Payload ID: 1067;
  Gene Symbol: ANK3;
  Gene Name: ankyrin 3, node of Ranvier (ankyrin G);
  ENSP ID: ENSP00000483244
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVSCS

SEQ ID NO: 4903 - protein, 63 aa, Homo sapiens
  Payload ID: 1067;
  Gene Symbol: ANK3;
  Gene Name: ankyrin 3, node of Ranvier (ankyrin G);
  ENSP ID: ENSP00000483483
MTGDTDKYLGPQDLKELGDDSLPAEGYMGFSLGARSASHAASTVAKELTDKTGRTNLSHIFQN

SEQ ID NO: 4904 - protein, 1434 aa, Homo sapiens
  Payload ID: 1068;
  Gene Symbol: ANKAR;
  Gene Name: ankyrin and armadillo repeat containing;
  Uniprot ID:  Q7Z5J8;
  ENSP ID: ENSP00000313513
MLRLPKKGLPRFEQVQDEDTYLENLAIQRNASAFFEKYDRSEIQELLTTALVSWLSAKEDVRSQVDLPCGIMSQMNNVGFSTAILLTPVDPTALLDYREVHQMIRELAIGIYCLNQIPSISLEANYDQSSSCQLPPAYYDTRIGQILINIDYMLKALWHGIYMPKEKRARFSELWRAIMDIDPDGKPQTNKDIFSEFSSAGLTDITKDPDFNEIYDEDVNEDPTYDPNSPEETAVFMKYAENIMLKLTFSTTQIQQYENVFIFETGYWLTNAIKYNQDYLDICTYQRLQQRLYLQKKIIQKHFEKKKDIRRGIGYLKLICFLIPFLLSLKKKMKVPYLSSLLQPFSDDKVKTERELPPFIYGRDFKCQNFHYKENQYFHVHGGIEFDISTPSIENALEDFQKNLEKIRDCAANTFIEDSGYKEYYSIPVMEFHGKSYYVIYFELETFYQQLYKTQWWGAINEIVNNLRLKRLPLTDAQLHEQFKKKLGFKRAMKCKSIPFGMKSAVERGLSAVFHTFSRKTSSSTINVSDEAGYTIFHHAALHNRVSIICQLCNANFKVNQRRFVTFSQGPTPLHLAAQACSLETTVCLLCSKADYTLSEKRGWMPIHFAAFYDNVCIIIALCRKDPSLLEAEATAENQCTPLLLAATSGALDTIQYLFSIGANWRKTDIKGNNIIHLSVLTFHTEVLKYIIKLNIPELPVWKTLVEMLQCESYKRRMMAVMSLEVICLANDQYWRCILDAGTIPALINLLKSSKIKLQCKTVGLLSNISTHKSAVHALVEAGGIPSLINLLVCDEPEVHSRCAVILYDIAQCENKDVIAKYNGIPSLINLLNLNIENVLVNVMNCIRVLCIGNENNQRAVREHKGLPYLIRFLSSDSDVLKAVSSAAIAEVGRDNKEIQDAIAMEGAIPPLVALFKGKQISVQMKGAMAVESLASHNALIQKAFLEKSLTKYLLKLLKAFQIDVKEQGAVALWALAGQTLKQQKYMAEQIGYSFIINMLLSPSAKMQYVGGEAVIALSKDSRMHQNQICEGNGIAPLVRLLRISTIAEGTLLSVIRAVGSICIGVAHTSNPVSQQLVVDENAFPVLIQLLRNHPSPNIKVEVAFSLACIVLGNDVLQKDLHENEGFEYADVLYLLHSTEKDICLRAGYALTLFAFNNRFQQYLILESGIMTISIFERFLESTVETEKAMAAFQIVVLAKVIRDMDHITLSARGVTILVDSLYSVQTSTIVLTGNLIASLAHSRAGIPEAFTTLGTIQRLCYHLYSGIEEVRAACSSALGYLTYNANAFRILLKECRNKPNQFIRIKNNISRDASINPAFLKEFQMQQTLVGLPSLSLEKNGGPSIIPIFKRGKEHRRKLKPKIQPKDSLTLLPPVTNFMGLFKATKKTKDSHNIFSFSSTITSDITNVSRPRIVCLNQLGKHVQKANPEPAEG

SEQ ID NO: 4905 - protein, 1009 aa, Homo sapiens
  Payload ID: 1068;
  Gene Symbol: ANKAR;
  Gene Name: ankyrin and armadillo repeat containing;
  ENSP ID: ENSP00000399928
MSQMNNVGFSTAILLTPVDPTALLDYREVHQMIRELAIGIYCLNQIPSISLEANYDQSSSCQLPPAYYDTRIGQILINIDYMLKALWHGIYMPKEKRARFSELWRAIMDIDPDGKPQTNKDIFSEFSSAGLTDITKDPDFNEIYDEDVNEDPTYDPNSPEETAVFMKYAENIMLKLTFSTTQIQQYENVFIFETGYWLTNAIKYNQDYLDICTYQRLQQRLYLQKKIIQKHFEKKKDIRRGIGYLKLICFLIPFLLSLKKKMKVPYLSSLLQPFSDDKVKTERELPPFIYGRDFKCQNFHYKENQYFHVHGGIEFDISTPSIENALEDFQKNLEKIRDCAANTFIEDSGYKEYYSIPVMEFHGKSYYVIYFELETFYQQLYKTQWWGAINEIVNNLRLKRLPLTDAQLHEQFKKKLGFKRAMKCKSIPFGMKSAVERGLSAVFHTFSRKTSSSTINVSDEAGYTIFHHAALHNRVSIICQLCNANFKVNQRRFVTFSQGPTPLHLAAQACSLETTVCLLCSKADYTLSEKRGWMPIHFAAFYDNVCIIIALCRKDPSLLEAEATAENQCTPLLLAATSGALDTIQYLFSIGANWRKTDIKGNNIIHLSVLTFHTEVLKYIIKLNIPELPVWKTLVEMLQCESYKRRMMAVMSLEVICLANDQYWRCILDAGTIPALINLLKSSKIKLQCKTVGLLSNISTHKSAVHALVEAGGIPSLINLLVCDEPEVHSRCAVILYDIAQCENKDVIAKYNGIPSLINLLNLNIENVLVNVMNCIRVLCIGNENNQRAVREHKGLPYLIRFLSSDSDVLKAVSSAAIAEVGRDNKEIQDAIAMEGAIPPLVALFKGKQISVQMKGAMAVESLASHNALIQKAFLEKSLTKYLLKLLKAFQIDVKEQGAVALWALAGQTLKQQKYMAEQIGYSFIINMLLSPSAKMQYVGGEAVIALSKDSRMHQNQICEGNGIAPLVRLLRISTIAEGTLLSVIRAVGSICIGYLLKSRLCINTFCLQ

SEQ ID NO: 4906 - protein, 801 aa, Homo sapiens
  Payload ID: 1068;
  Gene Symbol: ANKAR;
  Gene Name: ankyrin and armadillo repeat containing;
  Uniprot ID:  Q7Z5J8;
  ENSP ID: ENSP00000407459
MKYAENIMLKLTFSTTQIQQYENVFIFETGYWLTNAIKYNQDYLDICTYQRLQQRLYLQKKIIQKHFEKKKDIRRGIGYLKLICFLIPFLLSLKKKMKVPYLSSLLQPFSDDKVKTERELPPFIYGRDFKCQNFHYKENQYFHVHGGIEFDISTPSIENALEDFQKNLEKIRDCAANTFIEDSGYKEYYSIPVMEFHGKSYYVIYFELETFYQQLYKTQWWGAINEIVNNLRLKRLPLTDAQLHEQFKKKLGFKRAMKCKSIPFGMKSAVERGLSAVFHTFSRKTSSSTINVSDEAGYTIFHHAALHNRVSIICQLCNANFKVNQRRFVTFSQGPTPLHLAAQACSLETTVCLLCSKADYTLSEKRGWMPIHFAAFYDNVCIIIALCRKDPSLLEAEATAENQCTPLLLAATSGALDTIQYLFSIGANWRKTDIKGNNIIHLSVLTFHTEVLKYIIKLNIPELPVWKTLVEMLQCESYKRRMMAVMSLEVICLANDQYWRCILDAGTIPALINLLKSSKIKLQCKTVGLLSNISTHKSAVHALVEAGGIPSLINLLVCDEPEVHSRCAVILYDIAQCENKDVIAKYNGIPSLINLLNLNIENVLVNVMNCIRVLCIGNENNQRAVREHKGLPYLIRFLSSDSGLFNLFLNSFEDVLKAVSSAAIAEVGRDNKEIQDAIAMEGAIPPLVALFKGKQISVQMKGAMAVESLASHNALIQKAFLEKSLTKYLLKLLKAFQIDVKEQGAVALWALAGQTLKQQKYMAEQIGYSFIINMLLSPSAKMQYVGYLLKSRLCINTFCLQ

SEQ ID NO: 4907 - protein, 1434 aa, Homo sapiens; identical to SEQ ID NO: 4904
  Payload ID: 1068;
  Gene Symbol: ANKAR;
  Gene Name: ankyrin and armadillo repeat containing;
  Uniprot ID:  Q7Z5J8;
  ENSP ID: ENSP00000427882

SEQ ID NO: 4908 - protein, 478 aa, Homo sapiens
  Payload ID: 1069;
  Gene Symbol: ABTB1;
  Gene Name: ankyrin repeat and BTB (POZ) domain containing 1;
  Uniprot ID:  Q969K4;
  ENSP ID: ENSP00000232744
MDTSDLFASCRKGDVGRVRYLLEQRDVEVNVRDKWDSTPLYYACLCGHEELVLYLLANGARCEANTFDGERCLYGALSDPIRRALRDYKQVTASCRRRDYYDDFLQRLLEQGIHSDVVFVVHGKPFRVHRCVLGARSAYFANMLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGDLWELPFPCPDGFNSCPDICFRVAGCSFLCHKAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKLVEREDFVEAVKEEAAAVAARQETDSIPLVDDIRFHVASTVQTYSAIEEAQQRLRALEDLLVSIGLDC

SEQ ID NO: 4909 - protein, 336 aa, Homo sapiens
  Payload ID: 1069;
  Gene Symbol: ABTB1;
  Gene Name: ankyrin repeat and BTB (POZ) domain containing 1;
  Uniprot ID:  Q969K4;
  ENSP ID: ENSP00000412684
MLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGDLWELPFPCPDGFNSCPDICFRVAGCSFLCHKAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKLVEREDFVEAVKEEAAAVAARQETDSIPLVDDIRFHVASTVQTYSAIEEAQQRLRALEDLLVSIGLDC

SEQ ID NO: 4910 - protein, 336 aa, Homo sapiens; identical to SEQ ID NO: 4909
  Payload ID: 1069;
  Gene Symbol: ABTB1;
  Gene Name: ankyrin repeat and BTB (POZ) domain containing 1;
  Uniprot ID:  Q969K4;
  ENSP ID: ENSP00000417366

SEQ ID NO: 4911 - protein, 141 aa, Homo sapiens
  Payload ID: 1069;
  Gene Symbol: ABTB1;
  Gene Name: ankyrin repeat and BTB (POZ) domain containing 1;
  ENSP ID: ENSP00000418439
  MOD_RES (1)..(1): Any amino acid
XPGTCVKVLTIEPPPADPRLREDMALLADCALPPELRGDLWELPFPCPDGFNSCPDICFRVAGCSFLCHKAFFCGRSDYFRALLDDHFRESEEPATSGGPPAVTLHGISPDVFTHVLYYMYSDHTEPPQVGMVIYTSWTGN

SEQ ID NO: 4912 - protein, 57 aa, Homo sapiens
  Payload ID: 1069;
  Gene Symbol: ABTB1;
  Gene Name: ankyrin repeat and BTB (POZ) domain containing 1;
  ENSP ID: ENSP00000418641
MDTSDLFASCRKGDVGRVRYLLEQRDVEVLCLLVWARGAGTLPSGQWSPLRGQHLRW

SEQ ID NO: 4913 - protein, 57 aa, Homo sapiens; identical to SEQ ID NO: 4912
  Payload ID: 1069;
  Gene Symbol: ABTB1;
  Gene Name: ankyrin repeat and BTB (POZ) domain containing 1;
  ENSP ID: ENSP00000420748

SEQ ID NO: 4914 - protein, 1025 aa, Homo sapiens
  Payload ID: 1070;
  Gene Symbol: ABTB2;
  Gene Name: ankyrin repeat and BTB (POZ) domain containing 2;
  Uniprot ID:  Q8N961;
  ENSP ID: ENSP00000410157
MAGTYSSTLKTLEDLTLDSGYGAGDSCRSLSLSSSKSNSQALNSSAQQHRGAAWWCYSGSMNSRHNSWDTVNTVLPEDPEVADLFSRCPRLPELEEFPWTEGDVARVLRKGAGGRRLPQFSAEAVRRLAGLLRRALIRVAREAQRLSVLHAKCTRFEVQSAVRLVHSWALAESCALAAVKALSLYSMSAGDGLRRGKSARCGLTFSVGRFFRWMVDTRISVRIHEYAAISLTACMENLVEEIRARVMASHSPDGGGAGGGEVSAEALEMVINNDAELWGVLQPYEHLICGKNANGVLSLPAYFSPYNGGSLGHDERADAYAQLELRTLEQSLLATCVGSISELSDLVSRAMHHMQGRHPLCPGASPARQARQPPQPITWSPDALHTLYYFLRCPQMESMENPNLDPPRMTLNNERPFMLLPPLMEWMRVAITYAEHRRSLTVDSGDIRQAARLLLPGLDCEPRQLKPEHCFSSFRRLDARAATEKFNQDLGFRMLNCGRTDLINQAIEALGPDGVNTMDDQGMTPLMYACAAGDEAMVQMLIDAGANLDIQVPSNSPRHPSIHPDSRHWTSLTFAVLHGHISVVQLLLDAGAHVEGSAVNGGEDSYAETPLQLASAAGNYELVSLLLSRGADPLLSMLEAHGMGSSLHEDMNCFSHSAAHGHRNVLRKLLTQPQQAKADVLSLEEILAEGVEESDASSQGSGSEGPVRLSRTRTKALQEAMYYSAEHGYVDITMELRALGVPWKLHIWIESLRTSFSQSRYSVVQSLLRDFSSIREEEYNEELVTEGLQLMFDILKTSKNDSVIQQLATIFTHCYGSSPIPSIPEIRKTLPARLDPHFLNNKEMSDVTFLVEGKLFYAHKVLLVTASNRFKTLMTNKSEQDGDSSKTIEISDMKYHIFQMMMQYLYYGGTESMEIPTTDILELLSAASLFQLDALQRHCEILCSQTLSMESAVNTYKYAKIHNAPELALFCEGFFLKHMKALLEQDAFRQLIYGRSSKVQGLDPLQDLQNTLAERVHSVYITSRV

SEQ ID NO: 4915 - protein, 522 aa, Homo sapiens
  Payload ID: 1071;
  Gene Symbol: ANKDD1A;
  Gene Name: ankyrin repeat and death domain containing 1A;
  Uniprot ID:  Q495B1;
  ENSP ID: ENSP00000325895
MQEELAWETDGLLPLERQLHEAARQNNVGRMQELIGRRVNTRARNHVGRVALHWAAGAGHEQAVRLLLEHEAAVDEEDAVGALTEARLCFGMNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQKNLSCLHYAALSGSEDVSRVLIHAGGCANVVDHQGASPLHLAVRHNFPALVRLLINSDSDVNAVDNRQQTPLHLAAEHAWQDIADMLLIAGVDLNLRDKQGKTALAVAVRSNHVSLVDMIIKADRFYRWEKDHPSDPSGKSLSFKQDHRQETQQLRSVLWRLASRYLQPREWKKLAYSWEFTEAHVDAIEQQWTGTRSYQEHGHRMLLIWLHGVATAGENPSKALFEGLVAIGRRDLAGWSTMARSQLTATSASRVQMILVPQPPE

SEQ ID NO: 4916 - protein, 423 aa, Homo sapiens
  Payload ID: 1071;
  Gene Symbol: ANKDD1A;
  Gene Name: ankyrin repeat and death domain containing 1A;
  ENSP ID: ENSP00000379070
MNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQKNLSCLHYAALSGSEDVSRVLIHAGGCANVVDHQGASPLHLAVRHNFPALVRLLINSDSDVNAVDNRQQTPLHLAAEHAWQDIADMLLIAGVDLNLRDKQGKTALAVAVRSNHVSLVDMIIKADRFYRWEKDHPSDPSGKSLSFKQDHRQETQQLRSVLWRLASRYLQPREWKKLAYSWEFTEAHVDAIEQQWTGTRSYQEHGHRMLLIWLHGVATAGENPSKALFEGLVAIGRRDLAENIRKKANAAPSAPRRCTAM

SEQ ID NO: 4917 - protein, 399 aa, Homo sapiens
  Payload ID: 1071;
  Gene Symbol: ANKDD1A;
  Gene Name: ankyrin repeat and death domain containing 1A;
  ENSP ID: ENSP00000379073
MNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQKNLSCLHYAALSGSEDVSRVLIHAGGCANVVDHQGASPLHLAVRHNFPALVRLLINSDSDVNAVDNRQQTPLHLAAEHAWQDIADMLLIAGVDLNLRDKDHPSDPSGKSLSFKQDHRQETQQLRSVLWRLASRYLQPREWKKLAYSWEFTEAHVDAIEQQWTGTRSYQEHGHRMLLIWLHGVATAGENPSKALFEGLVAIGRRDLAGWSTMARSQLTATSASRVQMILVPQPPE

SEQ ID NO: 4918 - protein, 181 aa, Homo sapiens
  Payload ID: 1071;
  Gene Symbol: ANKDD1A;
  Gene Name: ankyrin repeat and death domain containing 1A;
  ENSP ID: ENSP00000420999
MNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQVARPSQDCGRLLAAEP

SEQ ID NO: 4919 - protein, 133 aa, Homo sapiens
  Payload ID: 1071;
  Gene Symbol: ANKDD1A;
  Gene Name: ankyrin repeat and death domain containing 1A;
  ENSP ID: ENSP00000423548
IGRRVNTRARNHVGRVALHWAAGAGHEQAVRLLLEHEAAVDEEDAVGALTEEGNTALHLAAGRGHMAVLQRLVDIGLDLEEQNAEGLTALHSAAGGSHPDCVQLLLRAGSTVNALTQVARPSQDCGRLLAAEP

SEQ ID NO: 4920 - protein, 123 aa, Homo sapiens
  Payload ID: 1071;
  Gene Symbol: ANKDD1A;
  Gene Name: ankyrin repeat and death domain containing 1A;
  ENSP ID: ENSP00000427091
MQEELAWETDGLLPLERQLHEAARQNNVGRMQELIGRRVNTRARNHVGRVALHWAAGAGHEQAVRLLLEHEAAVDEEDAFGMNALLLSAWFGHLRILQILVNSGAKIHCESKPKKAMCLCWRS

SEQ ID NO: 4921 - protein, 423 aa, Homo sapiens; identical to SEQ ID NO: 4916
  Payload ID: 1071;
  Gene Symbol: ANKDD1A;
  Gene Name: ankyrin repeat and death domain containing 1A;
  ENSP ID: ENSP00000484388

SEQ ID NO: 4922 - protein, 528 aa, Homo sapiens
  Payload ID: 1072;
  Gene Symbol: ANKDD1B;
  Gene Name: ankyrin repeat and death domain containing 1B;
  Uniprot ID:  A6NHY2;
  ENSP ID: ENSP00000471417
MDPAGRARGQGATAGGLLLRAAAAAKGLREDLWGAAALPWRSLSRIPKREGLGEEDTAVAGHELLLPNERSFQNAAKSNNLDLMEKLFEKKVNINVVNNMNRTALHFAVGRNHLSAVDFLLKHKARVDVADKHGLTVIHLAAWSGSLEVMLMLVKAGADQRAKNQDGMSALHFATQSNHVRIVEYLIQDLHLKDLNQPDEKGRKPFLLAAERGHVEMIEKLTFLNLHTSEKDKGGNTALHLAAKHGHSPAVQVLLAQWQDINEMNELNISSLQIATRNGHASLVNFLLSENVDLHQKVEPKESPLHLVVINNHITVVNSLLSAQHDIDILNQKQQTPLHVAADRGNVELVETLLKAGCDLKAVDKQGKTALAVASRSNHSLVVGMLIKAERYYAWREEHHESIRDPSTGFTLTFKQDHSLETRHIRTLLWDLAYHQLKANEWQRLARSWNFTDDQIRAIEEQWSGNESFREHGHRALLIWLHGTLMTQGDPAKQLYEELVHAGFPKLAEKTRHFKSKTDSNSKKCVVS

SEQ ID NO: 4923 - protein, 776 aa, Homo sapiens
  Payload ID: 1073;
  Gene Symbol: ANKEF1;
  Gene Name: ankyrin repeat and EF-hand domain containing 1;
  Uniprot ID:  Q9NU02;
  ENSP ID: ENSP00000367631
MALADKRLENLQIYKVLQCVRNKDKKQIEKLTKLGYPELINYTEPINGLSALHLASVSNDIDMVSFLLDLGAHPDVQDRMGCTPTMRAAELGHELSMEILAKAKADMTIVDNEGKGVLFYCILPTKRHYRCALIALEHGADVNNSTYEGKPIFLRACEDAHDVKDVCLTFLEKGANPNAINSSTGRTALMEASREGVVEIVRGILERGGEVNAFDNDRHHAAHFAAKGGFFDILKLLFAYNGDVGLISINGNTPLHYAAMGGFADCCKYIAQRGCDLKWKNLDHKTPRAVAKEGGFKAASKEIRRAERIANKLARPGAKNPNPLWALRLHDWSVEREAFLREAFAVLDRGDGSISKNDFVMVLEERQDYASSEQLAAIAHLHEKTRGGGVNINEFFKGTRYLNKSFVLGSYGPKKKEKGMGKKGKKGKFVLPLPICVIPEYAFPRRQDGGPPYYMIETYKNVTDSSRFNRDHPPEHPIQDDSVWYIDDSEKVFSNINIITKAGDLASLKKAFESGIPVDMKDNYYKTPLMTACASGNIDVVKFLLEKGANVNATDNFLWTPLHFACHAGQQDIVELLVESGALIDAASINNSTPLNRAIESCRLDTVKYLLDIGAKFQLENRKGHSAMDVAKAYADYRIIDLIKEKLDNLPKPAENQKLKGKTPPILKTEGPEIKKEEELLSSIYGVPTTSEGKKVQKGNVVHLNSLITSGYTKKVDITFIPRRIWSPEATTAELIRKRELRRERFTHEVDFDDFMMPFQKNITEKARALEAALKT

SEQ ID NO: 4924 - protein, 776 aa, Homo sapiens; identical to SEQ ID NO: 4923
  Payload ID: 1073;
  Gene Symbol: ANKEF1;
  Gene Name: ankyrin repeat and EF-hand domain containing 1;
  Uniprot ID:  Q9NU02;
  ENSP ID: ENSP00000367644

SEQ ID NO: 4925 - protein, 1169 aa, Homo sapiens
  Payload ID: 1074;
  Gene Symbol: ANKFY1;
  Gene Name: ankyrin repeat and FYVE domain containing 1;
  Uniprot ID:  Q9P2R3;
  ENSP ID: ENSP00000343362
MAEEEVAKLEKHLMLLRQEYVKLQKKLAETEKRCALLAAQANKESSSESFISRLLAIVADLYEQEQYSDLKIKVGDRHISAHKFVLAARSDSWSLANLSSTKELDLSDANPEVTMTMLRWIYTDELEFREDDVFLTELMKLANRFQLQLLRERCEKGVMSLVNVRNCIRFYQTAEELNASTLMNYCAEIIASHWDDLRKEDFSSMSAQLLYKMIKSKTEYPLHKAIKVEREDVVFLYLIEMDSQLPGKLNEADHNGDLALDLALSRRLESIATTLVSHKADVDMVDKSGWSLLHKGIQRGDLFAATFLIKNGAFVNAATLGAQETPLHLVALYSSKKHSADVMSEMAQIAEALLQAGANPNMQDSKGRTPLHVSIMAGNEYVFSQLLQCKQLDLELKDHEGSTALWLAVQHITVSSDQSVNPFEDVPVVNGTSFDENSFAARLIQRGSHTDAPDTATGNCLLQRAAGAGNEAAALFLATNGAHVNHRNKWGETPLHTACRHGLANLTAELLQQGANPNLQTEEALPLPKEAASLTSLADSVHLQTPLHMAIAYNHPDVVSVILEQKANALHATNNLQIIPDFSLKDSRDQTVLGLALWTGMHTIAAQLLGSGAAINDTMSDGQTLLHMAIQRQDSKSALFLLEHQADINVRTQDGETALQLAIRNQLPLVVDAICTRGADMSVPDEKGNPPLWLALANNLEDIASTLVRHGCDATCWGPGPGGCLQTLLHRAIDENNEPTACFLIRSGCDVNSPRQPGANGEGEEEARDGQTPLHLAASWGLEETVQCLLEFGANVNAQDAEGRTPIHVAISSQHGVIIQLLVSHPDIHLNVRDRQGLTPFACAMTFKNNKSAEAILKRESGAAEQVDNKGRNFLHVAVQNSDIESVLFLISVHANVNSRVQDASKLTPLHLAVQAGSEIIVRNLLLAGAKVNELTKHRQTALHLAAQQDLPTICSVLLENGVDFAAVDENGNNALHLAVMHGRLNNIRVLLTECTVDAEAFNLRGQSPLHILGQYGKENAAAIFDLFLECMPGYPLDKPDADGSTVLLLAYMKGNANLCRAIVRSGARLGVNNNQGVNIFNYQVATKQLLFRLLDMLSKEPPWCDGSYCYECTARFGVTTRKHHCRHCGRLLCHKCSTKEIPIIKFDLNKPVRVCNICFDVLTLGGVS

SEQ ID NO: 4926 - protein, 60 aa, Homo sapiens
  Payload ID: 1074;
  Gene Symbol: ANKFY1;
  Gene Name: ankyrin repeat and FYVE domain containing 1;
  ENSP ID: ENSP00000459247
MAIAYNHPDVVSVILEQKANALHATNNLQIIPDFSLKDSRDQTVLGLALWTGMHTIAAQL

SEQ ID NO: 4927 - protein, 1170 aa, Homo sapiens
  Payload ID: 1074;
  Gene Symbol: ANKFY1;
  Gene Name: ankyrin repeat and FYVE domain containing 1;
  Uniprot ID:  Q9P2R3;
  ENSP ID: ENSP00000459775
MAEEEVAKLEKHLMLLRQEYVKLQKKLAETEKRCALLAAQANKESSSESFISRLLAIVADLYEQEQYSDLKIKVGDRHISAHKFVLAARSDSWSLANLSSTKELDLSDANPEVTMTMLRWIYTDELEFREDDVFLTELMKLANRFQLQLLRERCEKGVMSLVNVRNCIRFYQTAEELNASTLMNYCAEIIASHWDDLRKEDFSSMSAQLLYKMIKSKTEYPLHKAIKVEREDVVFLYLIEMDSQLPGKLNEADHNGDLALDLALSRRLESIATTLVSHKADVDMVDKSGWSLLHKGIQRGDLFAATFLIKNGAFVNAATLGAQETPLHLVALYSSKKHSADVMSEMAQIAEALLQAGANPNMQDSKGRTPLHVSIMAGNEYVFSQLLQCKQLDLELKDHEGSTALWLAVQHITVSSDQSVNPFEDVPVVNGTSFDENSFAARLIQRGSHTDAPDTATGNCLLQRAAGAGNEAAALFLATNGAHVNHRNKWGETPLHTACRHGLANLTAELLQQGANPNLQTEEALPLPKEAASLTSLADSVHLQTPLHMAIAYNHPDVVSVILEQKANALHATNNLQIIPDFSLKDSRDQTVLGLALWTGMHTIAAQLLGSGAAINDTMSDGQTLLHMAIQRQDSKSALFLLEHQADINVSRTQDGETALQLAIRNQLPLVVDAICTRGADMSVPDEKGNPPLWLALANNLEDIASTLVRHGCDATCWGPGPGGCLQTLLHRAIDENNEPTACFLIRSGCDVNSPRQPGANGEGEEEARDGQTPLHLAASWGLEETVQCLLEFGANVNAQDAEGRTPIHVAISSQHGVIIQLLVSHPDIHLNVRDRQGLTPFACAMTFKNNKSAEAILKRESGAAEQVDNKGRNFLHVAVQNSDIESVLFLISVHANVNSRVQDASKLTPLHLAVQAGSEIIVRNLLLAGAKVNELTKHRQTALHLAAQQDLPTICSVLLENGVDFAAVDENGNNALHLAVMHGRLNNIRVLLTECTVDAEAFNLRGQSPLHILGQYGKENAAAIFDLFLECMPGYPLDKPDADGSTVLLLAYMKGNANLCRAIVRSGARLGVNNNQGVNIFNYQVATKQLLFRLLDMLSKEPPWCDGSYCYECTARFGVTTRKHHCRHCGRLLCHKCSTKEIPIIKFDLNKPVRVCNICFDVLTLGGVS

SEQ ID NO: 4928 - protein, 1211 aa, Homo sapiens
  Payload ID: 1074;
  Gene Symbol: ANKFY1;
  Gene Name: ankyrin repeat and FYVE domain containing 1;
  Uniprot ID:  Q9P2R3;
  ENSP ID: ENSP00000459943
MPTPRDCGRLRSRAGRSRAGAACSRGAPRAAREALDCRRCRDAGGKEVAKLEKHLMLLRQEYVKLQKKLAETEKRCALLAAQANKESSSESFISRLLAIVADLYEQEQYSDLKIKVGDRHISAHKFVLAARSDSWSLANLSSTKELDLSDANPEVTMTMLRWIYTDELEFREDDVFLTELMKLANRFQLQLLRERCEKGVMSLVNVRNCIRFYQTAEELNASTLMNYCAEIIASHWDDLRKEDFSSMSAQLLYKMIKSKTEYPLHKAIKVEREDVVFLYLIEMDSQLPGKLNEADHNGDLALDLALSRRLESIATTLVSHKADVDMVDKSGWSLLHKGIQRGDLFAATFLIKNGAFVNAATLGAQETPLHLVALYSSKKHSADVMSEMAQIAEALLQAGANPNMQDSKGRTPLHVSIMAGNEYVFSQLLQCKQLDLELKDHEGSTALWLAVQHITVSSDQSVNPFEDVPVVNGTSFDENSFAARLIQRGSHTDAPDTATGNCLLQRAAGAGNEAAALFLATNGAHVNHRNKWGETPLHTACRHGLANLTAELLQQGANPNLQTEEALPLPKEAASLTSLADSVHLQTPLHMAIAYNHPDVVSVILEQKANALHATNNLQIIPDFSLKDSRDQTVLGLALWTGMHTIAAQLLGSGAAINDTMSDGQTLLHMAIQRQDSKSALFLLEHQADINVRTQDGETALQLAIRNQLPLVVDAICTRGADMSVPDEKGNPPLWLALANNLEDIASTLVRHGCDATCWGPGPGGCLQTLLHRAIDENNEPTACFLIRSGCDVNSPRQPGANGEGEEEARDGQTPLHLAASWGLEETVQCLLEFGANVNAQDAEGRTPIHVAISSQHGVIIQLLVSHPDIHLNVRDRQGLTPFACAMTFKNNKSAEAILKRESGAAEQVDNKGRNFLHVAVQNSDIESVLFLISVHANVNSRVQDASKLTPLHLAVQAGSEIIVRNLLLAGAKVNELTKHRQTALHLAAQQDLPTICSVLLENGVDFAAVDENGNNALHLAVMHGRLNNIRVLLTECTVDAEAFNLRGQSPLHILGQYGKENAAAIFDLFLECMPGYPLDKPDADGSTVLLLAYMKGNANLCRAIVRSGARLGVNNNQGVNIFNYQVATKQLLFRLLDMLSKEPPWCDGSYCYECTARFGVTTRKHHCRHCGRLLCHKCSTKEIPIIKFDLNKPVRVCNICFDVLTLGGVS

SEQ ID NO: 4929 - protein, 69 aa, Homo sapiens
  Payload ID: 1074;
  Gene Symbol: ANKFY1;
  Gene Name: ankyrin repeat and FYVE domain containing 1;
  ENSP ID: ENSP00000460619
MAEEEVAKLEKHLMLLRQEYVKLQKKLAETEKRCALLAAQANKESSSESFISRLLAIVADLYEQEQYRC

SEQ ID NO: 4930 - protein, 80 aa, Homo sapiens
  Payload ID: 1074;
  Gene Symbol: ANKFY1;
  Gene Name: ankyrin repeat and FYVE domain containing 1;
  ENSP ID: ENSP00000467522
  MOD_RES (1)..(1): Any amino acid
XLLLAYMKGNANLCRAIVRSGARLGVNNNQGVNIFNYQVATKQLLFRLLDMLSKEPPWCDGSYCYECTARFGVTTRKHHW

SEQ ID NO: 4931 - protein, 1089 aa, Homo sapiens
  Payload ID: 1075;
  Gene Symbol: ANKIB1;
  Gene Name: ankyrin repeat and IBR domain containing 1;
  Uniprot ID:  Q9P2G1;
  ENSP ID: ENSP00000265742
MGNTTTKFRKALINGDENLACQIYENNPQLKESLDPNTSYGEPYQHNTPLHYAARHGMNKILGTFLGRDGNPNKRNVHNETSMHLLCMGPQIMISEGALHPRLARPTEDDFRRADCLQMILKWKGAKLDQGEYERAAIDAVDNKKNTPLHYAAASGMKACVELLVKHGGDLFAENENKDTPCDCAEKQHHKDLALNLESQMVFSRDPEAEEIEAEYAALDKREPYEGLRPQDLRRLKDMLIVETADMLQAPLFTAEALLRAHDWDREKLLEAWMSNPENCCQRSGVQMPTPPPSGYNAWDTLPSPRTPRTTRSSVTSPDEISLSPGDLDTSLCDICMCSISVFEDPVDMPCGHDFCRGCWESFLNLKIQEGEAHNIFCPAYDCFQLVPVDIIESVVSKEMDKRYLQFDIKAFVENNPAIKWCPTPGCDRAVRLTKQGSNTSGSDTLSFPLLRAPAVDCGKGHLFCWECLGEAHEPCDCQTWKNWLQKITEMKPEELVGVSEAYEDAANCLWLLTNSKPCANCKSPIQKNEGCNHMQCAKCKYDFCWICLEEWKKHSSSTGGYYRCTRYEVIQHVEEQSKEMTVEAEKKHKRFQELDRFMHYYTRFKNHEHSYQLEQRLLKTAKEKMEQLSRALKETEGGCPDTTFIEDAVHVLLKTRRILKCSYPYGFFLEPKSTKKEIFELMQTDLEMVTEDLAQKVNRPYLRTPRHKIIKAACLVQQKRQEFLASVARGVAPADSPEAPRRSFAGGTWDWEYLGFASPEEYAEFQYRRRHRQRRRGDVHSLLSNPPDPDEPSESTLDIPEGGSSSRRPGTSVVSSASMSVLHSSSLRDYTPASRSENQDSLQALSSLDEDDPNILLAIQLSLQESGLALDEETRDFLSNEASLGAIGTSLPSRLDSVPRNTDSPRAALSSSELLELGDSLMRLGAENDPFSTDTLSSHPLSEARSDFCPSSSDPDSAGQDPNINDNLLGNIMAWFHDMNPQSIALIPPATTEISADSQLPCIKDGSEGVKDVELVLPEDSMFEDASVSEGRGTQIEENPLEENILAGEAASQAGDSGNEAANRGDGSDVSSQTPQTSSDWLEQVHLV

SEQ ID NO: 4932 - protein, 54 aa, Homo sapiens
  Payload ID: 1075;
  Gene Symbol: ANKIB1;
  Gene Name: ankyrin repeat and IBR domain containing 1;
  ENSP ID: ENSP00000396406
  MOD_RES (1)..(1): Any amino acid
XRMKAAITCSVLSASMTFAGFALKSGKNIVRPLEVITDVLAMKSFNTWRSNPRK

SEQ ID NO: 4933 - protein, 84 aa, Homo sapiens
  Payload ID: 1075;
  Gene Symbol: ANKIB1;
  Gene Name: ankyrin repeat and IBR domain containing 1;
  ENSP ID: ENSP00000406644
  MOD_RES (1)..(1): Any amino acid
XLPSPRTPRTTRSSVTSPDEISLSPGDLDTSLCDICMCSISVFEDPVDMPCGHDFCRGCWESIVISRESLPMISSVNFTCKIKI

SEQ ID NO: 4934 - protein, 134 aa, Homo sapiens
  Payload ID: 1075;
  Gene Symbol: ANKIB1;
  Gene Name: ankyrin repeat and IBR domain containing 1;
  ENSP ID: ENSP00000407002
MGNTTTKFRKALINGDENLACQIYENNPQLKESLDPNTSYGEPYQHNTPLHYAARHGMNKILGTFLGRDGNPNKRNVHNETSMHLLCMGPQIMISEGALHPRLARPTEDDFRRADCLQMILKWKGAKLDQGEYE

SEQ ID NO: 4935 - protein, 162 aa, Homo sapiens
  Payload ID: 1075;
  Gene Symbol: ANKIB1;
  Gene Name: ankyrin repeat and IBR domain containing 1;
  ENSP ID: ENSP00000407913
  MOD_RES (1)..(1): Any amino acid
XTFLGRDGNPNKRNVHNETSMHLLCMGPQIMISEGALHPRLARPTEDDFRRADCLQMILKWKGAKLDQGEYERAAIDAVDNKKNTPLHYAAASGMKACVELLVKHGGDLFAENENKDTPCDCAEKQHHKDLALNLESQMVFSRDPEAEEIEAEYAALDKREY

SEQ ID NO: 4936 - protein, 687 aa, Homo sapiens
  Payload ID: 1076;
  Gene Symbol: ANKHD1;
  Gene Name: ankyrin repeat and KH domain containing 1;
  ENSP ID: ENSP00000246149
  MOD_RES (1)..(1): Any amino acid
XKAGADIELGCSTPLMEASQEGHLELVKYLLASGANVHATTATGDTALTYACENGHTDVADVLLQAGADLDKQEDMKTILEGIDPAKHQEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQEPDRTSQENSPALLGVQKAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRK

SEQ ID NO: 4937 - protein, 866 aa, Homo sapiens
  Payload ID: 1076;
  Gene Symbol: ANKHD1;
  Gene Name: ankyrin repeat and KH domain containing 1;
  ENSP ID: ENSP00000297183
MDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQIWPGTWAPHIGNMHLKYVN

SEQ ID NO: 4938 - protein, 2542 aa, Homo sapiens
  Payload ID: 1076;
  Gene Symbol: ANKHD1;
  Gene Name: ankyrin repeat and KH domain containing 1;
  Uniprot ID:  Q8IWZ3;
  ENSP ID: ENSP00000354085
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSSTSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQIWPGTWAPHIGNMHLKYVN

SEQ ID NO: 4939 - protein, 616 aa, Homo sapiens
  Payload ID: 1076;
  Gene Symbol: ANKHD1;
  Gene Name: ankyrin repeat and KH domain containing 1;
  Uniprot ID:  Q8IWZ3;
  ENSP ID: ENSP00000378211
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQVRVAFDACKLLRKE

SEQ ID NO: 4940 - protein, 627 aa, Homo sapiens
  Payload ID: 1076;
  Gene Symbol: ANKHD1;
  Gene Name: ankyrin repeat and KH domain containing 1;
  Uniprot ID:  Q8IWZ3;
  ENSP ID: ENSP00000378212
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQVRVAFDACKLLRKE

SEQ ID NO: 4941 - protein, 1072 aa, Homo sapiens
  Payload ID: 1076;
  Gene Symbol: ANKHD1;
  Gene Name: ankyrin repeat and KH domain containing 1;
  ENSP ID: ENSP00000390034
PKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMGLPISMYGGTIIPSHPQLADVPGGPLFNGLHNPDPAWNPMIKVIQNSTECTDAQQIWPGTWAPHIGNMHLKYVN

SEQ ID NO: 4942 - protein, 1215 aa, Homo sapiens
  Payload ID: 1076;
  Gene Symbol: ANKHD1;
  Gene Name: ankyrin repeat and KH domain containing 1;
  ENSP ID: ENSP00000393204
VQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQIWPGTWAPHIGNMHLKYVN

SEQ ID NO: 4943 - protein, 1565 aa, Homo sapiens
  Payload ID: 1076;
  Gene Symbol: ANKHD1;
  Gene Name: ankyrin repeat and KH domain containing 1;
  ENSP ID: ENSP00000394489
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNK

SEQ ID NO: 4944 - protein, 185 aa, Homo sapiens
  Payload ID: 1076;
  Gene Symbol: ANKHD1;
  Gene Name: ankyrin repeat and KH domain containing 1;
  ENSP ID: ENSP00000405345
  MOD_RES (1)..(1): Any amino acid
XTSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQVKWA

SEQ ID NO: 4945 - protein, 608 aa, Homo sapiens
  Payload ID: 1076;
  Gene Symbol: ANKHD1;
  Gene Name: ankyrin repeat and KH domain containing 1;
  ENSP ID: ENSP00000405602
EHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREK

SEQ ID NO: 4946 - protein, 1024 aa, Homo sapiens
  Payload ID: 1076;
  Gene Symbol: ANKHD1;
  Gene Name: ankyrin repeat and KH domain containing 1;
  ENSP ID: ENSP00000410959
  MOD_RES (1)..(1): Any amino acid
XTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSSTSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMGLPISMYGGTIIPSHPQLADVPGGPLFNGLHNPDPAWNPMIKVIQNSTECTDAQQIWPGTWAPHIGNMHLKYVN

SEQ ID NO: 4947 - protein, 934 aa, Homo sapiens
  Payload ID: 1076;
  Gene Symbol: ANKHD1;
  Gene Name: ankyrin repeat and KH domain containing 1;
  ENSP ID: ENSP00000415887
  MOD_RES (1)..(1): Any amino acid
XKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQIWPGTWAPHIGNMHLKYVN

SEQ ID NO: 4948 - protein, 368 aa, Homo sapiens
  Payload ID: 1076;
  Gene Symbol: ANKHD1;
  Gene Name: ankyrin repeat and KH domain containing 1;
  ENSP ID: ENSP00000421069
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYK

SEQ ID NO: 4949 - protein, 581 aa, Homo sapiens
  Payload ID: 1076;
  Gene Symbol: ANKHD1;
  Gene Name: ankyrin repeat and KH domain containing 1;
  Uniprot ID:  Q8IWZ3;
  ENSP ID: ENSP00000478529
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGQAGGHEDYFGGHRSGQASGEGGL

SEQ ID NO: 4950 - protein, 765 aa, Homo sapiens
  Payload ID: 1077;
  Gene Symbol: ANKK1;
  Gene Name: ankyrin repeat and kinase domain containing 1;
  Uniprot ID:  Q8NFD2;
  ENSP ID: ENSP00000306678
MAADPTELRLGSLPVFTRDDFEGDWRLVASGGFSQVFQARHRRWRTEYAIKCAPCLPPDAASSDVNYLIEEAAKMKKIKFQHIVSIYGVCKQPLGIVMEFMANGSLEKVLSTHSLCWKLRFRIIHETSLAMNFLHSIKPPLLHLDLKPGNILLDSNMHVKISDFGLSKWMEQSTRMQYIERSALRGMLSYIPPEMFLESNKAPGPKYDVYSFAIVIWELLTQKKPYSGFNMMMIIIRVAAGMRPSLQPVSDQWPSEAQQMVDLMKRCWDQDPKKRPCFLDITIETDILLSLLQSRVAVPESKALARKVSCKLSLRQPGEVNEDISQELMDSDSGNYLKRALQLSDRKNLVPRDEELCIYENKVTPLHFLVAQGSVEQVRLLLAHEVDVDCQTASGYTPLLIAAQDQQPDLCALLLAHGADANRVDEDGWAPLHFAAQNGDDGTARLLLDHGACVDAQEREGWTPLHLAAQNNFENVARLLVSRQADPNLHEAEGKTPLHVAAYFGHVSLVKLLTSQGAELDAQQRNLRTPLHLAVERGKVRAIQHLLKSGAVPDALDQSGYGPLHTAAARGKYLICKMLLRYGASLELPTHQGWTPLHLAAYKGHLEIIHLLAESHANMGALGAVNWTPLHLAARHGEEAVVSALLQCGADPNAAEQSGWTPLHLAVQRSTFLSVINLLEHHANVHARNKVGWTPAHLAALKGNTAILKVLVEAGAQLDVQDGVSCTPLQLALRSRKQGIMSFLEGKEPSVATLGGSKPGAEMEI

SEQ ID NO: 4951 - protein, 54 aa, Homo sapiens
  Payload ID: 1077;
  Gene Symbol: ANKK1;
  Gene Name: ankyrin repeat and kinase domain containing 1;
  ENSP ID: ENSP00000445810
  MOD_RES (1)..(1): Any amino acid
XSLCWKLRFRIIHETSLAMNFLHSIKPPLLHLDLKPGNILLDSNMHVKVKKLRL

SEQ ID NO: 4952 - protein, 669 aa, Homo sapiens
  Payload ID: 1078;
  Gene Symbol: ANKLE1;
  Gene Name: ankyrin repeat and LEM domain containing 1;
  Uniprot ID:  Q8NAG6;
  ENSP ID: ENSP00000377971
MWTPVRRGAAWLGTLLGPGEGPPEPRGGAAHAHKPPAGSRKSTDQAVRFGPSQGMCSEARLARRLRDALREEEPWAVEELLRCGADPNLVLEDGAAAVHLAAGARHPRGLRCLGALLRQGGDPNARSVEALTPLHVAAAWGCRRGLELLLSQGADPALRDQDGLRPLDLALQQGHLECARVLQDLDTRTRTRTRIGAETQEPEPAPGTPGLSGPTDETLDSIALQKQPCRGDNRDIGLEADPGPPSLPVPLETVDKHGSSASPPGHWDYSSDASFVTAVEVSGAEDPASDTPPWAGSLPPTRQGLLHVVHANQRVPRSQGTEAELNARLQALTLTPPNAAGFQSSPSSMPLLDRSPAHSPPRTPTPGASDCHCLWEHQTSIDSDMATLWLTEDEASSTGGREPVGPCRHLPVSTVSDLELLKGLRALGENPHPITPFTRQLYHQQLEEAQIAPGPEFSGHSLELAAALRTGCIPDVQADEDALAQQFEQPDPARRWREGVVKSSFTYLLLDPRETQDLPARAFSLTPAERLQTFIRAIFYVGKGTRARPYVHLWEALGHHGRSRKQPHQACPKVRQILDIWASGCGVVSLHCFQHVVAVEAYTREACIVEALGIQTLTNQKQGHCYGVVAGWPPARRRRLGVHLLHRALLVFLAEGERQLHPQDIQARG

SEQ ID NO: 4953 - protein, 85 aa, Homo sapiens
  Payload ID: 1078;
  Gene Symbol: ANKLE1;
  Gene Name: ankyrin repeat and LEM domain containing 1;
  ENSP ID: ENSP00000384008
MWTPVRRGAAWLGTLLGPGEGPPEPRGGAAHAHKPPAGSRKSTDQAVRFGPSQGMCSEARLARRLRDALREEEPCRGAAALRRGP

SEQ ID NO: 4954 - protein, 439 aa, Homo sapiens
  Payload ID: 1078;
  Gene Symbol: ANKLE1;
  Gene Name: ankyrin repeat and LEM domain containing 1;
  ENSP ID: ENSP00000384753
MWTPVRRGAAWLGTLLGPGEGPPEPRGGAAHAHKPPAGSRKSTDQAVRFGPSQGMCSEARLARRLRDALREEEPWAVEELLRCGADPNLVLEDGAAAVHLAAGARHPRGLRCLGALLRQGGDPNARSVEALTPLHVAAAWGCRRGLELLLSQGADPALRDQDGLRPLDLALQQGHLECARVLQDLDTRTRTRTRIGAETQEPEPAPGTPGLSGPTDETLDSIALQKQPCRGDNRDIGLEADPGPPSLPVPLETVDKHGSSASPPGHWDYSSDASFVTAVEVSGAEDPASDTPPWAGSLPPTRQGLLHVVHANQRVPRSQGTEAELNARLQALTLTPPNAAGFQSSPSSMPLLDRSPAHSPPRTPTPGASDCHCLWEHQTSIDSDMATLWLTEDEASSTGGREPVGPCRHLPVSTVSDLELLKGLRALGRLRTCQPEPSH

SEQ ID NO: 4955 - protein, 643 aa, Homo sapiens
  Payload ID: 1078;
  Gene Symbol: ANKLE1;
  Gene Name: ankyrin repeat and LEM domain containing 1;
  ENSP ID: ENSP00000468845
MWTPVRRGAAWLGTLLGPGEGPPEPRGGAAHAHKPPAGSRKSTDQAVRFGPSQGMCSEARLARRLRDALREEEPWAVEELLRCGADPNLVLEDGAAAVHLAAGARHPRGLRCLGALLRQGGDPNARSVEALTPLHVAAAWGCRRGLELLLSQGADPALRDQDGLRPLDLALQQGHLECARVLQDLDTRTRTRTRIGAETQEPEPAPGTPGLSGPTDETLDSIALQKQPCRGDNRDIGLEADPGPPSLPVPLETVDKHGSSASPPGHWDYSSDASFVTAVEVSGAEDPASDTPPWAGSLPPTRQGLLHVVHANQRVPRSQGTEAELNARLQALTLTPPNAAGFQSSPSSMPLLDRSPAHSPPRTPTPGASDCHCLWEHQTSIDSDMATLWLTEDEASSTGGREPVGPCRHLPVSTVSDLELLKGLRALGPEFSGHSLELAAALRTGCIPDVQADEDALAQQFEQPDPARRWREGVVKSSFTYLLLDPRETQDLPARAFSLTPAERLQTFIRAIFYVGKGTRARPYVHLWEALGHHGRSRKQPHQACPKVRQILDIWASGCGVVSLHCFQHVVAVEAYTREACIVEALGIQTLTNQKQGHCYGVVAGWPPARRRRLGVHLLHRALLVFLAEGERQLHPQDIQARG

SEQ ID NO: 4956 - protein, 598 aa, Homo sapiens
  Payload ID: 1078;
  Gene Symbol: ANKLE1;
  Gene Name: ankyrin repeat and LEM domain containing 1;
  ENSP ID: ENSP00000470895
  MOD_RES (1)..(1): Any amino acid
XMCSEARLARRLRDALREEEPWAVEELLRCGADPNLVLEDGAAAVHLAAGARHPRGLRCLGALLRQGGDPNARSVEALTPLHVAAAWGCRRGLELLLSQGADPALRDQDGLRPLDLALQQGHLECARVLQDLDTRTRTRTRIGAETQEPEPAPGTPGLSGPTDETLDSIALQKQPCRGDNRDIGLEADPGPPSLPVPLETVDKHGSSASPPGHWDYSSDASFVTAVEVSGAEDPASDTPPWAGSLPPTRQGLLHVVHANQRVPRSQGTEAELNARLQALTLTPPNAAGFQSSPSSMPLLDRSPAHSPPRTPTPGASDCHCLWEHQTSIDSDMATLWLTEDEASSTGGREPVGPCRHLPVSTVSDLELLKGLRALGPEFSGHSLELAAALRTGCIPDVQADEDALAQQFEQPDPARRWREGVVKSSFTYLLLDPRETQDLPARAFSLTPAERLQTFIRAIFYVGKGTRARPYVHLWEALGHHGRSRKQGSRRSPTRSKGTAMEWWQAGHLLVAGAWGCTCCTVPSLSSWLKASDSFIPRTSRPGAECWGVGHPAWGEMFECSSCPMLTAAPISGFRRGVCVCVCVCVCVCVCLCVCVCV

SEQ ID NO: 4957 - protein, 938 aa, Homo sapiens
  Payload ID: 1079;
  Gene Symbol: ANKLE2;
  Gene Name: ankyrin repeat and LEM domain containing 2;
  Uniprot ID:  Q86XL3;
  ENSP ID: ENSP00000350686
MLWPRLAAAEWAALAWELLGASVLLIAVRWLVRRLGPRPGGLGRSGTPVPPPSAAAAPASGEMTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPLYYGVCPVYEDVPARNERIYVYENKKEALQAVKMIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDVICERSKNKSVELKERIREYLKGHYYVPLLRAEETSSPVIGELWSPDQTAEASHVSRYGGSPRDPVLTLRAFAGPLSPAKAEDFRKLWKTPPREKAGFLHHVKKSDPERGFERVGRELAHELGYPWVEYWEFLGCFVDLSSQEGLQRLEEYLTQQEIGKKAQQETGEREASCRDKATTSGSNSISVRAFLDEDDMSLEEIKNRQNAARNNSPPTVGAFGHTRCSAFPLEQEADLIEAAEPGGPHSSRNGLCHPLNHSRTLAGKRPKAPRGEEAHLPPVSDLTVEFDKLNLQNIGRSVSKTPDESTKTKDQILTSRINAVERDLLEPSPADQLGNGHRRTESEMSARIAKMSLSPSSPRHEDQLEVTREPARRLFLFGEEPSKLDQDVLAALECADVDPHQFPAVHRWKSAVLCYSPSDRQSWPSPAVKGRFKSQLPDLSGPHSYSPGRNSVAGSNPAKPGLGSPGRYSPVHGSQLRRMARLAELAAL

SEQ ID NO: 4958 - protein, 118 aa, Homo sapiens
  Payload ID: 1079;
  Gene Symbol: ANKLE2;
  Gene Name: ankyrin repeat and LEM domain containing 2;
  ENSP ID: ENSP00000437585
EGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDELHLDPASQQKVCV

SEQ ID NO: 4959 - protein, 293 aa, Homo sapiens
  Payload ID: 1079;
  Gene Symbol: ANKLE2;
  Gene Name: ankyrin repeat and LEM domain containing 2;
  Uniprot ID:  Q86XL3;
  ENSP ID: ENSP00000437807
MSLEEIKNRQNAARNNSPPTVGAFGHTRCSAFPLEQEADLIEAAEPGGPHSSRNGLCHPLNHSRTLAGKRPKAPRGEEAHLPPVSDLTVEFDKLNLQNIGRSVSKTPDESTKTKDQILTSRINAVERDLLEPSPADQLGNGHRRTESEMSARIAKMSLSPSSPRHEDQLEVTREPARRLFLFGEEPSKLDQDVLAALECADVDPHQFPAVHRWKSAVLCYSPSDRQSWPSPAVKGRFKSQLPDLSGPHSYSPGRNSVAGSNPAKPGLGSPGRYSPVHGSQLRRMARLAELAAL

SEQ ID NO: 4960 - protein, 293 aa, Homo sapiens; identical to SEQ ID NO: 4959
  Payload ID: 1079;
  Gene Symbol: ANKLE2;
  Gene Name: ankyrin repeat and LEM domain containing 2;
  Uniprot ID:  Q86XL3;
  ENSP ID: ENSP00000438551

SEQ ID NO: 4961 - protein, 258 aa, Homo sapiens
  Payload ID: 1079;
  Gene Symbol: ANKLE2;
  Gene Name: ankyrin repeat and LEM domain containing 2;
  ENSP ID: ENSP00000445760
MSLEEIKNRQNAARNNSPPTVGAFGHTRCSAFPLEQEADLIEAAEPGGPHSSRNGLCHPLNHSRTLAGKRPKAPRGEEAHLPPVSDLTVEFDKLNLQNIGRSVSKTPDESTKTKDQILTSRINAVERDLLEPSPADQLGNGHRRTESEMSARIAKMSLSPSSPRHEDQLEVTREPARRLFLFGEEPSKLDQDVLAALECADVDPHQFPAVHRWKSAVLCYSPSDRQSWPSPAVKGRFKSQLPDLSGPHSYSPGRNSVA

SEQ ID NO: 4962 - protein, 941 aa, Homo sapiens
  Payload ID: 1080;
  Gene Symbol: ANKMY1;
  Gene Name: ankyrin repeat and MYND domain containing 1;
  Uniprot ID:  Q9P2S6;
  ENSP ID: ENSP00000272972
MYQGEFGLNMKLGYGKFSWPTGESYHGQFYRDHCHGLGTYMWPDGSSFTGTFYLSHREGYGTMYMKTRLFQGLYKADQRFGPGVETYPDGSQDVGLWFREQLIKLCTQIPSGFSLLRYPEFSSFITHSPARISLSEEEKTEWGLQEGQDPFFYDYKRFLLNDNLTLPPEMYVYSTNSDHLPMTSSFRKELDARIFLNEIPPFVEDGEPWFIINETPLLVKIQKQTYKFRNKPAHTSWNMGAILEGKRSGFAPCGPKEQLSMEMILKAEEGNHEWICRILKDNFASADVADAKGYTVLAAAATHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIERRKRWRTIKLLLRRGADPNLCCVPMQVLFLAVKAGDVDGVRLLLEHGARTDICFPPQLSTLTPLHIAAALPGEEGVQIVELLLHAITDVDAKASDEDDTYKPGKLDLLPSSLKLSNEPGPPQAYYSTDTALPEEGGRTALHMACEREDDNKCARDIVRLLLSHGANPNLLWSGHSPLSLSIASGNELVVKELLTQGADPNLPLTKGLGSALCVACDLTYEHQRNMDSKLALIDRLISHGADILKPVMLRQGEKEAVGTAVDYGYFRFFQDRRIARCPFHTLMPAERETFLARKRLLEYMGLQLRQAVFAKESQWDPTWLYLCKRAELIPSHRMKKKGPSLPRGLDVKEQGQIPFFKFCYQCGRSIGVRLLPCPRCYGILTCSKYCKTKAWTEFHKKDCGDLVAIVTQLEQVSRRREEFQ

SEQ ID NO: 4963 - protein, 717 aa, Homo sapiens
  Payload ID: 1080;
  Gene Symbol: ANKMY1;
  Gene Name: ankyrin repeat and MYND domain containing 1;
  Uniprot ID:  Q9P2S6;
  ENSP ID: ENSP00000355097
MEGAHASLSLEDEVSGAGSRQRPLEGKGGETPAAEEPGSLKNYAVFATRDVSAAPEKEEEEAEGPLRAQDLRESYIQLVQGVQEWQDGCMYQGEFGLNMKLGYGKFSWPTGESYHGQFYRDHCHGLGTYMWPDGSSFTGTFYLSHREGYGTMYMKTRLFQTHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIERRKRWRTIKLLLRRGADPNLCCVPMQVLFLAVKAGDVDGVRLLLEHGARTDICFPPQLSTLTPLHIAAALPGEEGVQIVELLLHAITDVDAKASDEDDTYKPGKVVKELLTQGADPNLPLTKGLGSALCVACDLTYEHQRNMDSKLALIDRLISHGADILKPVMLRQGEKEAVGTAVDYGYFRFFQDRRIARCPFHTLMPAERETFLARKRLLEYMGLQLRQAVFAKESQWDPTWLYLCKRAELIPSHRMKKKGPSLPRGLDVKEQGQIPFFKFCYQCGRSIGVRLLPCPRCYGILTCSKYCKTKAWTEFHKKDCGDLVAIVTQLEQVSRRREEFQ

SEQ ID NO: 4964 - protein, 720 aa, Homo sapiens
  Payload ID: 1080;
  Gene Symbol: ANKMY1;
  Gene Name: ankyrin repeat and MYND domain containing 1;
  ENSP ID: ENSP00000362415
MEGAHASLSLEDEVSGAGSRQRPLEGKGGETPAAEEPGSLKNYAVFATRDVSAAPEKEEEEAEGPLRAQDLRESYIQLVQGVQEWQDGCMYQGEFGLNMKLGYGKFSWPTGESYHGQFYRDHCHGLGTYMWPDGSSFTGTFYLSHREGYGTMYMKTRLFQTHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIERRKRWRTIKLLLRRGADPNLCCVPMQVLFLAVKAGDVDGVRLLLEHGARTDICFPPQLSTLTPLHIAAALPGEEGVQIVELLLHAITDVDAKASDEDDTYKPGKLDLLPSSLKLSNEPGPPQAYYSTDTALPEEGGRTALHMACEREDDNKIDRLISHGADILKPVMLRQGEKEAVGTAVDYGYFRFFQDRRIARCPFHTLMPAERETFLARKRLLEYMGLQLRQAVFAKESQWDPTWLYLCKRAELIPSHRMKKKGPSLPRGLDVKEQGQIPFFKFCYQCGRSIGVRLLPCPRCYGILTCSKYCKTKAWTEFHKKDCGDLVAIVTQLEQVSRRREEFQ

SEQ ID NO: 4965 - protein, 246 aa, Homo sapiens
  Payload ID: 1080;
  Gene Symbol: ANKMY1;
  Gene Name: ankyrin repeat and MYND domain containing 1;
  ENSP ID: ENSP00000375847
MYQGEFGLNMKLGYGKFSWPTGESYHGQFYRDHCHGLGTYMWPDGSSFTGTFYLSHREGYGTMYMKTRLFQGLYKADQRFGPGVETYPDGSQDVGLWFREQLIKLCTQIPSGFSLLRYPEFSSFITHSPARISLSEEEKTEWGLQEGQDPFFYDYKRFLLNDNLTLPPEMYVYSTNSDHLPMTSSFRKELDARIFLNEIPPFVEDGEPWFIINETPLLVKIQKQTYKFRLTATTTLSTFSWTVGPT

SEQ ID NO: 4966 - protein, 190 aa, Homo sapiens
  Payload ID: 1080;
  Gene Symbol: ANKMY1;
  Gene Name: ankyrin repeat and MYND domain containing 1;
  ENSP ID: ENSP00000375848
  MOD_RES (1)..(1): Any amino acid
XKRWRTIKLLLRRGADPNLCCVPMQVLFLAVKAGDVDGVRLLLEHGARTDICFPPQLSTLTPLHIAAALPGEEGVQIVELLLHAITDVDAKASDEDDTYKPGKCARDIVRLLLSHGANPNLLWSGHSPLSLSIASGNELVVKELLTQGADPNLPLTKGLGSALCVACDLTYEHQRNMDSKLALIDRLISH

SEQ ID NO: 4967 - protein, 843 aa, Homo sapiens
  Payload ID: 1080;
  Gene Symbol: ANKMY1;
  Gene Name: ankyrin repeat and MYND domain containing 1;
  ENSP ID: ENSP00000383968
MAAHVGSRCASRSSAGSSNTGTRSSATPGARGPGCWRETLTHSVTPARASCSSAPAARALPRKSEGATRTNGGGWKTTDMEGAHASLSLEDEVSGAGSRQRPLEGKGGETPAAEEPGSLKNYAVFATRDVSAAPEKEEEEAEGPLRAQDLRESYIQLVQGVQEWQDGCMYQGEFGLNMKLGYGKFSWPTGESYHGQFYRDHCHGLGTYMWPDGSSFTGTFYLSHREGYGTMYMKTRLFQTHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIERRKRWRTIKLLLRRGADPNLCCVPMQVLFLAVKAGDVDGVRLLLEHGARTDICFPPQLSTLTPLHIAAALPGEEGVQIVELLLHAITDVDAKASDEDDTYKPGKLDLLPSSLKLSNEPGPPQAYYSTDTALPEEGGRTALHMACEREDDNKVVKELLTQGADPNLPLTKGLGSALCVACDLTYEHQRNMDSKLALIDRLISHGADILKPVMLRQGEKEAVGTAVDYGYFRFFQDRRIARCPFHTLMPAERETFLARKRLLEYMGLQLRQAVFAKESQWDPTWLYLCKRAELIPSHRMKKKGPSLPRGLDVKEQGQIPFFKFCYQCGRSIGVRLLPCPRCYGILTCSKYCKTKAWTEFHKKDCGDLVAIVTQLEQVSRRREEFQ

SEQ ID NO: 4968 - protein, 702 aa, Homo sapiens
  Payload ID: 1080;
  Gene Symbol: ANKMY1;
  Gene Name: ankyrin repeat and MYND domain containing 1;
  ENSP ID: ENSP00000384555
MEGAHASLSLEDEVSGAGSRQRPLEGKGGETPAAEEPGSLKNYAVFATRDVSAAPEKEEEEAEGPLRAQDLRESYIQLVQGVQEWQDGCMYQGEFGLNMKLGYGKFSWPTGESYHGQFYRDHCHGLGTYMWPDGSSFTGTFYLSHREGYGTMYMKTRLFQTHCHNDIVNLLLDCGADVNKCSDEGLTALSMCFLLHYPAQSFKPNVAERTIPEPQEPPKFPVVPILSSSFMDTNLESLYYELSQAMLERSAQSHSLLKMASPSPCTSSFDKGTMRRMALSMIERRKRWRTIKLLLRRGADPNLCCVPMQVLFLAVKAGDVDGVRLLLEHGARTDICFPPQLSTLTPLHIAAALPGEEGVQIVELLLHAITDVDAKASDEDDTYKPGKLDLLPSSLKLSNEPGPPQAYYSTDTALPEEGGRTALHMACEREDDNKCARDIVRLLLSHGANPNLLWSGHSPLSLSIASGNELVVKELLTQGADPNLPLTKGLGSALCVACDLTYEHQRNMDSKLALIDRLISHGADILKPVMLRQGEKEAVGTAVDYGYFRFFQDRRIARCPFHTLMPAERETFLARKRLLEYMGLQLRQAVFAKESQWDPTWLYLCKRAELIPSHRMKKKGPSLPRGLDVKEQGQIPFFKFCYQCGRSIGVRLLPCPRCYGILTCSKYCKTKAWTEFHKKDCGDLVAIVTQLEQVSRRREEFQ

SEQ ID NO: 4969 - protein, 292 aa, Homo sapiens
  Payload ID: 1080;
  Gene Symbol: ANKMY1;
  Gene Name: ankyrin repeat and MYND domain containing 1;
  ENSP ID: ENSP00000385145
MYQGEFGLNMKLGYGKFSWPTGESYHGQFYRDHCHGLGTYMWPDGSSFTGTFYLSHREGYGTMYMKTRLFQTHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIE

SEQ ID NO: 4970 - protein, 84 aa, Homo sapiens
  Payload ID: 1080;
  Gene Symbol: ANKMY1;
  Gene Name: ankyrin repeat and MYND domain containing 1;
  ENSP ID: ENSP00000385267
  MOD_RES (1)..(1): Any amino acid
XPLPHADASRARDVPGAEAAPGVHGLAATAGCLCQGEPVGPHVAVPVQERIPFFKFCYQCGRSIGVRLLPCPRCYGILTCSKYC

SEQ ID NO: 4971 - protein, 439 aa, Homo sapiens
  Payload ID: 1080;
  Gene Symbol: ANKMY1;
  Gene Name: ankyrin repeat and MYND domain containing 1;
  Uniprot ID:  Q9P2S6;
  ENSP ID: ENSP00000385635
MEGAHASLSLEDEVSGAGSRQRPLEGKGGETPAAEEPGSLKNYAVFATRDVSAAPEKEEEEAEGPLRAQDLRESYIQLVQGVQEWQDGCMYQGEFGLNMKLGYGKFSWPTGESYHGQFYRDHCHGLGTYMWPDGSSFTGTFYLSHREGYGTMYMKTRLFQTHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIERRKRWRTIKLLLRRGADPNLCCVPMQVLFLAVKAGDVDGVRLLLEHGARTDICFPPQC

SEQ ID NO: 4972 - protein, 1030 aa, Homo sapiens
  Payload ID: 1080;
  Gene Symbol: ANKMY1;
  Gene Name: ankyrin repeat and MYND domain containing 1;
  ENSP ID: ENSP00000385887
MEGAHASLSLEDEVSGAGSRQRPLEGKGGETPAAEEPGSLKNYAVFATRDVSAAPEKEEEEAEGPLRAQDLRESYIQLVQGVQEWQDGCMYQGEFGLNMKLGYGKFSWPTGESYHGQFYRDHCHGLGTYMWPDGSSFTGTFYLSHREGYGTMYMKTRLFQGLYKADQRFGPGVETYPDGSQDVGLWFREQLIKLCTQIPSGFSLLRYPEFSSFITHSPARISLSEEEKTEWGLQEGQDPFFYDYKRFLLNDNLTLPPEMYVYSTNSDHLPMTSSFRKELDARIFLNEIPPFVEDGEPWFIINETPLLVKIQKQTYKFRNKPAHTSWNMGAILEGKRSGFAPCGPKEQLSMEMILKAEEGNHEWICRILKDNFASADVADAKGYTVLAAAATHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIERRKRWRTIKLLLRRGADPNLCCVPMQVLFLAVKAGDVDGVRLLLEHGARTDICFPPQLSTLTPLHIAAALPGEEGVQIVELLLHAITDVDAKASDEDDTYKPGKLDLLPSSLKLSNEPGPPQAYYSTDTALPEEGGRTALHMACEREDDNKCARDIVRLLLSHGANPNLLWSGHSPLSLSIASGNELVVKELLTQGADPNLPLTKGLGSALCVACDLTYEHQRNMDSKLALIDRLISHGADILKPVMLRQGEKEAVGTAVDYGYFRFFQDRRIARCPFHTLMPAERETFLARKRLLEYMGLQLRQAVFAKESQWDPTWLYLCKRAELIPSHRMKKKGPSLPRGLDVKEQGQIPFFKFCYQCGRSIGVRLLPCPRCYGILTCSKYCKTKAWTEFHKKDCGDLVAIVTQLEQVSRRREEFQ

SEQ ID NO: 4973 - protein, 189 aa, Homo sapiens
  Payload ID: 1080;
  Gene Symbol: ANKMY1;
  Gene Name: ankyrin repeat and MYND domain containing 1;
  ENSP ID: ENSP00000404095
  MOD_RES (1)..(1): Any amino acid
XRSRGRVRARRAPTVEGLYKADQRFGPGVETYPDGSQDVGLWFREQLIKLCTQIPSGFSLLRYPEFSSFITHSPARISLSEEEKTEWGLQEGQDPFFYDYKRFLLNDNLTLPPEMYVYSTNSDHLPMTSSFRKELDARIFLNEIPPFVEDGEPWFIINETPLLVKIQKQTYKFRLTATTTLSTFSWTVG

SEQ ID NO: 4974 - protein, 74 aa, Homo sapiens
  Payload ID: 1080;
  Gene Symbol: ANKMY1;
  Gene Name: ankyrin repeat and MYND domain containing 1;
  ENSP ID: ENSP00000404337
MEGAHASLSLEDEVSGAGSRQRPLEGKGGETPAAEEPGSLKNYAVFATRDVSAAPEKEEEEAEGPLRAQDLRES

SEQ ID NO: 4975 - protein, 168 aa, Homo sapiens
  Payload ID: 1080;
  Gene Symbol: ANKMY1;
  Gene Name: ankyrin repeat and MYND domain containing 1;
  ENSP ID: ENSP00000405938
MRDVSAAPEKEEEEAEGPLRAQDLRESYIQLVQGVQEWQDGCMYQGEFGLNMKLGYGKFSWPTGESYHGQFYRDHCHGLGTYMWPDGSSFTGTFYLSHREGYGTMYMKTRLFQTHCHNDIVNLLLDCGADVNKCSDEGLTALSMCFLLHYPAQSFKPNVAERTIPEPQ

SEQ ID NO: 4976 - protein, 227 aa, Homo sapiens
  Payload ID: 1080;
  Gene Symbol: ANKMY1;
  Gene Name: ankyrin repeat and MYND domain containing 1;
  ENSP ID: ENSP00000407015
MYQGEFGLNMKLGYGKFSWPTGESYHGQFYRDHCHGLGTYMWPDGSSFTGTFYLSHREGYGTMYMKTRLFQGLYKADQRFGPGVETYPDGSQDVGLWFREQLIKLCTQIPSGFSLLRYPEFSSFITHSPARISLSEEEKTEWGLQEGQDPFFYDYKRFLLNDNLTLPPEMYVYSTNSDHLPMTSSFRKELDARIFLNEIPPFVEDGEPWFIINETPLLVKIQKQTYK

SEQ ID NO: 4977 - protein, 441 aa, Homo sapiens
  Payload ID: 1081;
  Gene Symbol: ANKMY2;
  Gene Name: ankyrin repeat and MYND domain containing 2;
  Uniprot ID:  Q8IV38;
  ENSP ID: ENSP00000303570
MVHIKKGELTQEEKELLEVIGKGTVQEAGTLLSSKNVRVNCLDENGMTPLMHAAYKGKLDMCKLLLRHGADVNCHQHEHGYTALMFAALSGNKDITWVMLEAGAETDVVNSVGRTAAQMAAFVGQHDCVTIINNFFPRERLDYYTKPQGLDKEPKLPPKLAGPLHKIITTTNLHPVKIVMLVNENPLLTEEAALNKCYRVMDLICEKCMKQRDMNEVLAMKMHYISCIFQKCINFLKDGENKLDTLIKSLLKGRASDGFPVYQEKIIRESIRKFPYCEATLLQQLVRSIAPVEIGSDPTAFSVLTQAITGQVGFVDVEFCTTCGEKGASKRCSVCKMVIYCDQTCQKTHWFTHKKICKNLKDIYEKQQLEAAKEKRQEENHGKLDVNSNCVNEEQPEAEVGISQKDSNPEDSGEGKKESLESEAELEGLQDAPAGPQVSEE

SEQ ID NO: 4978 - protein, 341 aa, Homo sapiens
  Payload ID: 1081;
  Gene Symbol: ANKMY2;
  Gene Name: ankyrin repeat and MYND domain containing 2;
  ENSP ID: ENSP00000392259
MVHIKKGELTQEEKELLEVIGKGTVQEAGTLLSSKNVRVNCLDENGMTPLMHAAYKGKLDMCKLLLRHGADVNCHQHEHGYTALMFAALSGNKDITWVMLEAGAETDVVNSVGRTAAQMAAFVGQHDCVTIINNFFPRERLDYYTKPQGLDKEPKLPPKLAGPLHKIITTTNLHPVKIVMLVNENPLLTEEAALNKCYRVMDLICEKCMKQRDMNEVLAMKMHYISCIFQKCINFLKDGENKLDTLIKSLLKGRASDGFPVYQEKIIRESIRKFPYCEATLLQQLVRSIAPVEIGSDPTAFSVLTQAITGQVGFVDVEFCTTCGEKGASKRCSVCKMCREL

SEQ ID NO: 4979 - protein, 69 aa, Homo sapiens
  Payload ID: 1081;
  Gene Symbol: ANKMY2;
  Gene Name: ankyrin repeat and MYND domain containing 2;
  ENSP ID: ENSP00000410075
MVHIKKGELTQEEKELLEVIGKGVPHFRSAESQRGAPRTSQKPYFPGVPEWTSQRSSLPSPVTWQVTSA

SEQ ID NO: 4980 - protein, 341 aa, Homo sapiens; identical to SEQ ID NO: 4978
  Payload ID: 1081;
  Gene Symbol: ANKMY2;
  Gene Name: ankyrin repeat and MYND domain containing 2;
  ENSP ID: ENSP00000485738

SEQ ID NO: 4981 - protein, 69 aa, Homo sapiens; identical to SEQ ID NO: 4979
  Payload ID: 1081;
  Gene Symbol: ANKMY2;
  Gene Name: ankyrin repeat and MYND domain containing 2;
  ENSP ID: ENSP00000486844

SEQ ID NO: 4982 - protein, 335 aa, Homo sapiens
  Payload ID: 1082;
  Gene Symbol: ASB1;
  Gene Name: ankyrin repeat and SOCS box containing 1;
  Uniprot ID:  Q9Y576;
  ENSP ID: ENSP00000264607
MAEGGSPDGRAGPGSAGRNLKEWLREQFCDHPLEHCEDTRLHDAAYVGDLQTLRSLLQEESYRSRINEKSVWCCGWLPCTPLRIAATAGHGSCVDFLIRKGAEVDLVDVKGQTALYVAVVNGHLESTQILLEAGADPNGSRHHRSTPVYHASRVGRADILKALIRYGADVDVNHHLTPDVQPRFSRRLTSLVVCPLYISAAYHNLQCFRLLLLAGANPDFNCNGPVNTQGFYRGSPGCVMDAVLRHGCEAAFVSLLVEFGANLNLVKWESLGPESRGRRKVDPEALQVFKEARSVPRTLLCLCRVAVRRALGKHRLHLIPSLPLPDPIKKFLLHE

SEQ ID NO: 4983 - protein, 234 aa, Homo sapiens
  Payload ID: 1082;
  Gene Symbol: ASB1;
  Gene Name: ankyrin repeat and SOCS box containing 1;
  ENSP ID: ENSP00000387025
MAEGGSPDGRAGPGSAGRNLKEWLREQFCDHPLEHCEDTRLHDAAYVGDLQTLRSLLQEESYRRYGADVDVNHHLTPDVQPRFSRRLTSLVVCPLYISAAYHNLQCFRLLLLAGANPDFNCNGPVNTQGFYRGSPGCVMDAVLRHGCEAAFVSLLVEFGANLNLVKWESLGPESRGRRKVDPEALQVFKEARSVPRTLLCLCRVAVRRALGKHRLHLIPSLPLPDPIKKFLLHE

SEQ ID NO: 4984 - protein, 61 aa, Homo sapiens
  Payload ID: 1082;
  Gene Symbol: ASB1;
  Gene Name: ankyrin repeat and SOCS box containing 1;
  ENSP ID: ENSP00000411773
MAEGGSPDGRAGPGSAAASTRSLSGAVAGSPAHRCESRPLQAMGAVWTSSSGRGPRWIWWT

SEQ ID NO: 4985 - protein, 429 aa, Homo sapiens
  Payload ID: 1083;
  Gene Symbol: ASB10;
  Gene Name: ankyrin repeat and SOCS box containing 10;
  Uniprot ID:  Q8WXI3;
  ENSP ID: ENSP00000275838
MLMSWSPEECKGQGEPLDDRHPLCARLVEKPSRGSEEHLKSGPGPIVTRTASGPALAFWQAVLAGDVGCVSRILADSSTGLAPDSVFDTSDPERWRDFRFNIRALRLWSLTYEEELTTPLHVAASRGHTEVLRLLLRRRARPDSAPGGRTALHEACAAGHTACVHVLLVAGADPNIADQDGKRPLHLCRGPGTLECAELLLRFGARVDGRSEEEEETPLHVAARLGHVELADLLLRRGACPDARNAEGWTPLLAACDVRCQSITDAEATTARCLQLCSLLLSAGADADAADQDKQRPLHLACRRGHAAVVELLLSCGVSANTMDYGGHTPLHCALQGPAAALAQSPEHVVRALLNHGAVRVWPGALPKKHQRFYSSLFALVRQPRSLQHLSRCALRSHLEGSLPQALPRLPLPPRLLRYLQLDFEGVLY

SEQ ID NO: 4986 - protein, 452 aa, Homo sapiens
  Payload ID: 1083;
  Gene Symbol: ASB10;
  Gene Name: ankyrin repeat and SOCS box containing 10;
  Uniprot ID:  Q8WXI3;
  ENSP ID: ENSP00000367098
MPWGKNSSPHWGHHLGCLPSAPACRIWRPHSRPAWEPPRPSPLLCQDMALQNALYTGDLARLQELFPPHSTADLLLESRAAEPRWSSHQRGLWSLTYEEELTTPLHVAASRGHTEVLRLLLRRRARPDSAPGGRTALHEACAAGHTACVHVLLVAGADPNIADQDGKRPLHLCRGPGTLECAELLLRFGARVDGRSEEEEETPLHVAARLGHVELADLLLRRGACPDARNAEGWTPLLAACDVRCQSITDAEATTARCLQLCSLLLSAGADADAADQDKQRPLHLACRRGHAAVVELLLSCGVSANTMDYGGHTPLHCALQGPAAALAQSPEHVVRALLNHGAVRVWPGALPKVLERWSTCPRTIEVLMNTYSVVQLPEEAVGLVTPETLQKHQRFYSSLFALVRQPRSLQHLSRCALRSHLEGSLPQALPRLPLPPRLLRYLQLDFEGVLY

SEQ ID NO: 4987 - protein, 467 aa, Homo sapiens
  Payload ID: 1083;
  Gene Symbol: ASB10;
  Gene Name: ankyrin repeat and SOCS box containing 10;
  Uniprot ID:  Q8WXI3;
  ENSP ID: ENSP00000391137
MLMSWSPEECKGQGEPLDDRHPLCARLVEKPSRGSEEHLKSGPGPIVTRTASGPALAFWQAVLAGDVGCVSRILADSSTGLAPDSVFDTSDPERWRDFRFNIRALRLWSLTYEEELTTPLHVAASRGHTEVLRLLLRRRARPDSAPGGRTALHEACAAGHTACVHVLLVAGADPNIADQDGKRPLHLCRGPGTLECAELLLRFGARVDGRSEEEEETPLHVAARLGHVELADLLLRRGACPDARNAEGWTPLLAACDVRCQSITDAEATTARCLQLCSLLLSAGADADAADQDKQRPLHLACRRGHAAVVELLLSCGVSANTMDYGGHTPLHCALQGPAAALAQSPEHVVRALLNHGAVRVWPGALPKVLERWSTCPRTIEVLMNTYSVVQLPEEAVGLVTPETLQKHQRFYSSLFALVRQPRSLQHLSRCALRSHLEGSLPQALPRLPLPPRLLRYLQLDFEGVLY

SEQ ID NO: 4988 - protein, 115 aa, Homo sapiens
  Payload ID: 1083;
  Gene Symbol: ASB10;
  Gene Name: ankyrin repeat and SOCS box containing 10;
  ENSP ID: ENSP00000410871
MPWGKNSSPHWGHHLGCLPSAPACRIWRPHSRPAWEPPRPSPLLCQDMALQNALYTGDLARLQELFPPHSTADLLLESRAAEPRWSSHQRGEGHLGVAENQGAGLTASATEVLRA

SEQ ID NO: 4989 - protein, 302 aa, Homo sapiens
  Payload ID: 1084;
  Gene Symbol: ASB11;
  Gene Name: ankyrin repeat and SOCS box containing 11, E3 ubiquitin prt ligase;
  Uniprot ID:  Q8WXH4;
  ENSP ID: ENSP00000343408
MLQLTGENEKNCEVSERIRRSGPWKEISFGDYICHTFQGDCWADRSPLHEAAAQGRLLALKTLIAQGVNVNLVTINRVSSLHEACLGGHVACAKALLENGAHVNGVTVHGATPLFNACCSGSAACVNVLLEFGAKAQLEVHLASPIHEAVKRGHRECMEILLANNVNIDHEVPQLGTPLYVACTYQRVDCVKKLLELGASVDHGQWLDTPLHAAARQSNVEVIHLLTDYGANLKRRNAQGKSALDLAAPKSSVEQALLLREGPPALSQLCRLCVRKCLGRACHQAIHKLHLPEPLERFLLYQ

SEQ ID NO: 4990 - protein, 306 aa, Homo sapiens
  Payload ID: 1084;
  Gene Symbol: ASB11;
  Gene Name: ankyrin repeat and SOCS box containing 11, E3 ubiquitin prt ligase;
  Uniprot ID:  Q8WXH4;
  ENSP ID: ENSP00000369837
MEDGPVFYGFKNIFITMFATFFFFKLLIKVFLALLTHFYIVKGNRKEAARIAEEIYGGISDCWADRSPLHEAAAQGRLLALKTLIAQACLGGHVACAKALLENGAHVNGVTVHGATPLFNACCSGSAACVNVLLEFGAKAQLEVHLASPIHEAVKRGHRECMEILLANNVNIDHEVPQLGTPLYVACTYQRVDCVKKLLELGASVDHGQWLDTPLHAAARQSNVEVIHLLTDYGANLKRRNAQGKSALDLAAPKSSVEQALLLREGPPALSQLCRLCVRKCLGRACHQAIHKLHLPEPLERFLLYQ

SEQ ID NO: 4991 - protein, 323 aa, Homo sapiens
  Payload ID: 1084;
  Gene Symbol: ASB11;
  Gene Name: ankyrin repeat and SOCS box containing 11, E3 ubiquitin prt ligase;
  Uniprot ID:  Q8WXH4;
  ENSP ID: ENSP00000417914
MEDGPVFYGFKNIFITMFATFFFFKLLIKVFLALLTHFYIVKGNRKEAARIAEEIYGGISDCWADRSPLHEAAAQGRLLALKTLIAQGVNVNLVTINRVSSLHEACLGGHVACAKALLENGAHVNGVTVHGATPLFNACCSGSAACVNVLLEFGAKAQLEVHLASPIHEAVKRGHRECMEILLANNVNIDHEVPQLGTPLYVACTYQRVDCVKKLLELGASVDHGQWLDTPLHAAARQSNVEVIHLLTDYGANLKRRNAQGKSALDLAAPKSSVEQALLLREGPPALSQLCRLCVRKCLGRACHQAIHKLHLPEPLERFLLYQ

SEQ ID NO: 4992 - protein, 224 aa, Homo sapiens
  Payload ID: 1084;
  Gene Symbol: ASB11;
  Gene Name: ankyrin repeat and SOCS box containing 11, E3 ubiquitin prt ligase;
  ENSP ID: ENSP00000419385
MEDGPVFYGFKNIFITMFATFFFFKLLIKVFLALLTHFYIVKGNRKEAARIAEEIYGGISDCWADRSPLHEAAAQGRLLALKTLIAQGVNVNLVTINRVSSLHEACLGGHVACAKALLENGAHVNGVTVHGATPLFNACCSGSAACVNVLLEFGAKAQLEVHLASPIHEAVKRESRAVAQAAVQWHDFCSLQPLAPGFKRFSCLSLPSSWDYRSQRVHGDPAGK

SEQ ID NO: 4993 - protein, 318 aa, Homo sapiens
  Payload ID: 1085;
  Gene Symbol: ASB12;
  Gene Name: ankyrin repeat and SOCS box containing 12;
  Uniprot ID:  Q8WXK4;
  ENSP ID: ENSP00000355195
MRIVLQLAKMNLMDITKIFSLLQPDKEEEDTDTEEKQALNQAVYDNDSYTLDQLLRQERYKRFINSRSGWGVPGTPLRLAASYGHLSCLQVLLAHGADVDSLDVKAQTPLFTAVSHGHLDCVRVLLEAGASPGGSIYNNCSPVLTAARDGAVAILQELLDHGAEANVKAKLPVWASNIASCSGPLYLAAVYGHLDCFRLLLLHGADPDYNCTDQGLLARVPRPRTLLEICLHHNCEPEYIQLLIDFGANIYLPSLSLDLTSQDDKGIALLLQARATPRSLLSQVRLVVRRALCQAGQPQAINQLDIPPMLISYLKHQL

SEQ ID NO: 4994 - protein, 278 aa, Homo sapiens
  Payload ID: 1086;
  Gene Symbol: ASB13;
  Gene Name: ankyrin repeat and SOCS box containing 13;
  Uniprot ID:  Q8WXK3;
  ENSP ID: ENSP00000350331
MEPRAADGCFLGDVGFWVERTPVHEAAQRGESLQLQQLIESGACVNQVTVDSITPLHAASLQGQARCVQLLLAAGAQVDARNIDGSTPLCDACASGSIECVKLLLSYGAKVNPPLYTASPLHEACMSGSSECVRLLIDVGANLEAHDCHFGTPLHVACAREHLDCVKVLLNAGANVNAAKLHETALHHAAKVKNVDLIEMLIEFGGNIYARDNRGKKPSDYTWSSSAPAKCFEYYEKTPLTLSQLCRVNLRKATGVRGLEKIAKLNIPPRLIDYLSYN

SEQ ID NO: 4995 - protein, 173 aa, Homo sapiens
  Payload ID: 1086;
  Gene Symbol: ASB13;
  Gene Name: ankyrin repeat and SOCS box containing 13;
  Uniprot ID:  Q8WXK3;
  ENSP ID: ENSP00000433358
MEPRAADGCFLGDVGFWVERTPVHEAAQRGESLQLQQLIESGACVNQVTVDSITPLHAASLQGQARCVQLLLAAGAQVDARNIDGSTPLCDACASGSIECVKLLLSYGAKVNPPLYTASPLHEACMSGSSECVRLLIDVGANLEAHDCHFGTPLHVACAREHLDCVKVLLNAA

SEQ ID NO: 4996 - protein, 587 aa, Homo sapiens
  Payload ID: 1087;
  Gene Symbol: ASB14;
  Gene Name: ankyrin repeat and SOCS box containing 14;
  Uniprot ID:  A6NK59;
  ENSP ID: ENSP00000374252
MDNYTSDEDIDEDFDTQLIIQQSLQDIYKPGTAQHAPKDESLHSFLSADYKKIVETIEKVGKEDALSHLTKYHSAFGEADEIGWIPLHKAAVQLNRKILEITLSASDPSLWEQTTHNGETPLFLAVSSCLLENATFLLLNGCNPNAKNFEGNSPLLAAVLRDCYDMAALLINYGADVNLRCANERTALHEAAKLGREDMVKLMLVSGAHPDPQSTYGFTPLALAAQSGHTEIMEMLLRKGKIFCLASDSSSILLEAASGGNPDAVALLLEYGADANIPKNSGHLPIHVAADRGHLLALKILIPVTDLAAIKQSGISPVHCAAAGAHPQCLELLIQAGFDVNFMLDQRINKHYDDHRKSALYFAVSNSDLSSVKLLLSAGALPNQDPVNCLQIALRMGNYELISLLLRHGANVNYFCRVNPLHFPSALQYTLKDEVMLRMLLNYGYDTERCFDCPHGDKVHPSYTVEGWTSTVIKDTKFCEVITLSWLQHLSGKVVRVMLDYVDQVRICSKLKAVLQKQGIWSEIHFILTNPRSLKHLCRLKIRKCMGRLHLRCPVFMSFLPLPNRLKAYVLYKEYDLYGQGIFTGTW

SEQ ID NO: 4997 - protein, 587 aa, Homo sapiens
  Payload ID: 1087;
  Gene Symbol: ASB14;
  Gene Name: ankyrin repeat and SOCS box containing 14;
  Uniprot ID:  A6NK59;
  ENSP ID: ENSP00000419199
MDNYTSDEDIDEDFDTQLIIQQSLQDIYKPGTAQHAPKDESLHSFLSADYKKIVETIEKGKEDALSHLTKYHSAFGEADEIGWIPLHKAAVQLNRKILEITLSASDPSLWEQTTHNGETPLFLAVSSCLLENATFLLLNGCNPNAKNFEGNSPLLAAVLRDCYDMAALLINYGADVNLRCANERTALHEAAKLGREDMVKLMLVSGAHPDPQSTYGFTPLALAAQSGHTEIMEMLLRKGANAHGQASDSSSILLEAASGGNPDAVALLLEYGADANIPKNSGHLPIHVAADRGHLLALKILIPVTDLAAIKQSGISPVHCAAAGAHPQCLELLIQAGFDVNFMLDQRINKHYDDHRKSALYFAVSNSDLSSVKLLLSAGALPNQDPVNCLQIALRMGNYELISLLLRHGANVNYFCRVNPLHFPSALQYTLKDEVMLRMLLNYGYDTERCFDCPHGDKVHPSYTVEGWTSTVIKDTKFCEVITLSWLQHLSGKVVRVMLDYVDQVRICSKLKAVLQKQGIWSEIHFILTNPRSLKHLCRLKIRKCMGRLHLRCPVFMSFLPLPNRLKAYVLYKEYDLYGQGIFTGTW

SEQ ID NO: 4998 - protein, 588 aa, Homo sapiens
  Payload ID: 1088;
  Gene Symbol: ASB15;
  Gene Name: ankyrin repeat and SOCS box containing 15;
  Uniprot ID:  Q8WXK1;
  ENSP ID: ENSP00000275699
MDTNDDPDEDHLTSYDIQLSIQESIEASKTALCPERFVPLSAQNRKLVEAIKQGHIPELQEYVKYKYAMDEADEKGWFPLHEAVVQPIQQILEIVLDASYKTLWEFKTCDGETPLTLAVKAGLVENVRTLLEKGVWPNTKNDKGETPLLIAVKKGSYDMVSTLIKHNTSLDQPCVKRWSAMHEAAKQGRKDIVALLLKHGGNVHLRDGFGVTPLGVAAEYGHCDVLEHLIHKGGDVLALADDGASVLFEAAGGGNPDCISLLLEYGGSGNVPNRAGHLPIHRAAYEGHYLALKYLIPVTSKNAIRKSGLTPIHSAADGQNAQCLELLIENGFDVNTLLADHISQSYDDERKTALYFGVSNNDVHCTEVLLAAGADPNLDPLNCLLVAVRANNYEIVRLLLSHGANVNCYFMHVNDTRFPSVIQYALNDEVMLRLLLNNGYQVEMCFDCMHGDIFGNSFVWSEIQEEVLPGWTSCVIKDNPFCEFITVPWMKHLVGRVTRVLIDYMDYVPLCAKLKSALEVQREWPEIRQILENPCSLKHLCRLKIRRLMGLQKLCQPASVEKLPLPPAIQRYILFKEYDLYGQELKLT

SEQ ID NO: 4999 - protein, 588 aa, Homo sapiens; identical to SEQ ID NO: 4998
  Payload ID: 1088;
  Gene Symbol: ASB15;
  Gene Name: ankyrin repeat and SOCS box containing 15;
  Uniprot ID:  Q8WXK1;
  ENSP ID: ENSP00000390963

SEQ ID NO: 5000 - protein, 588 aa, Homo sapiens; identical to SEQ ID NO: 4998
  Payload ID: 1088;
  Gene Symbol: ASB15;
  Gene Name: ankyrin repeat and SOCS box containing 15;
  Uniprot ID:  Q8WXK1;
  ENSP ID: ENSP00000397655

SEQ ID NO: 5001 - protein, 241 aa, Homo sapiens
  Payload ID: 1088;
  Gene Symbol: ASB15;
  Gene Name: ankyrin repeat and SOCS box containing 15;
  ENSP ID: ENSP00000401166
MDTNDDPDEDHLTSYDIQLSIQESIEASKTALCPERFVPLSAQNRKLVEAIKQGHIPELQEYVKYKYAMDEADEKGWFPLHEAVVQPIQQILEIVLDASYKTLWEFKTCDGETPLTLAVKAGLVENVRTLLEKGVWPNTKNDKGETPLLIAVKKGSYDMVSTLIKHNTSLDQPCVKRWSAMHEAAKQGRKDIVALLLKHGGNVHLRDGFGVTPLGVAAEYGHCDVLEHLIHKGGDVLALAD

SEQ ID NO: 5002 - protein, 97 aa, Homo sapiens
  Payload ID: 1088;
  Gene Symbol: ASB15;
  Gene Name: ankyrin repeat and SOCS box containing 15;
  ENSP ID: ENSP00000406163
MDTNDDPDEDHLTSYDIQLSIQESIEASKTALCPERFVPLSAQNRKLVEAIKQGHIPELQEYVKYKYAMDEADEKGWFPLHEAVVQPIQQILEIVLD

SEQ ID NO: 5003 - protein, 588 aa, Homo sapiens; identical to SEQ ID NO: 4998
  Payload ID: 1088;
  Gene Symbol: ASB15;
  Gene Name: ankyrin repeat and SOCS box containing 15;
  Uniprot ID:  Q8WXK1;
  ENSP ID: ENSP00000416433

SEQ ID NO: 5004 - protein, 249 aa, Homo sapiens
  Payload ID: 1088;
  Gene Symbol: ASB15;
  Gene Name: ankyrin repeat and SOCS box containing 15;
  ENSP ID: ENSP00000438643
MKQPSKAEYGHCDVLEHLIHKGGDVLALADDGASVLFEAAGGGNPDCISLLLEYGGSGNVPNRAGHLPIHRAAYEGHYLALKYLIPVTSKNAIRKSGLTPIHSAADGQNAQCLELLIENGFDVNTLLADHISQSYDDERKTALYFGVSNNDVHCTEVLLAAGADPNLDPLNCLLVAVRANNYEIVRLLLSHGANVNCYFMHVNDTRFPSVIQYALNDEVMLRLLLNNGYQVEMCFDCMHGDIFGNSFVC

SEQ ID NO: 5005 - protein, 453 aa, Homo sapiens
  Payload ID: 1089;
  Gene Symbol: ASB16;
  Gene Name: ankyrin repeat and SOCS box containing 16;
  Uniprot ID:  Q96NS5;
  ENSP ID: ENSP00000293414
MARETFPFTSSMLRSLRLQQEWLEWEDRRRAAAQQCRSRRCPSSPRARLTRPHRSCRDPAVHQALFSGNLQQVQALFQDEEAANMIVETVSNQLAWSAEQGFWVLTPKTKQTAPLAIATARGYTDCARHLIRQGAELDARVGGRAALHEACARAQFDCVRLLLTFGAKANVLTEEGTTPLHLCTIPESLQCAKLLLEAGATVNLAAGESQETPLHVAAARGLEQHVALYLEHGADVGLRTSQGETALNTACAGAEGPGSCRRHQAAARRLLEAGADARAAGRKRHTPLHNACANGCGGLAELLLRYGARAEVPNGAGHTPMDCALQAVQDSPNWEPEVLFAALLDYGAQPVRPEMLKHCANFPRALEVLLNAYPCVPSCETWVEAVLPELWKEHEAFYSSALCMVNQPRQLQHLARLAVRARLGSRCRQGATRLPLPPLLRDYLLLRVEGCIQ

SEQ ID NO: 5006 - protein, 273 aa, Homo sapiens
  Payload ID: 1089;
  Gene Symbol: ASB16;
  Gene Name: ankyrin repeat and SOCS box containing 16;
  ENSP ID: ENSP00000466033
MARETFPFTSSMLRSLRLQQEWLEWEDRRRAAAQQCRSRRCPSSPRARLTRPHRSCRDPAVHQALFSGNLQQVQALFQDEEAANMIVETVSNQLAWSAEQGFWVLTPKTKQTAPLAIATARGYTDCARHLIRQGAELDARVGGRAALHEACARAQFDCVRLLLTFGAKANVLTEEGTTPLHLCTIPESLQCAKLLLEAGATVNLAAGESQETPLHVAAARGLEQHVALYLEHGADVGLRTSQGETALNTACAGAEGPDAETLRQLPSGPGSPA

SEQ ID NO: 5007 - protein, 71 aa, Homo sapiens
  Payload ID: 1089;
  Gene Symbol: ASB16;
  Gene Name: ankyrin repeat and SOCS box containing 16;
  ENSP ID: ENSP00000466349
MIVETVSNQLAWSAEQGFWVLTPKTKQTAPLAIATARGYTDCARHLIRQGAELDARVGGRAALHEACARAQ

SEQ ID NO: 5008 - protein, 295 aa, Homo sapiens
  Payload ID: 1090;
  Gene Symbol: ASB17;
  Gene Name: ankyrin repeat and SOCS box containing 17;
  Uniprot ID:  Q8WXJ9;
  ENSP ID: ENSP00000284142
MSKSTKLCGKTSCPRSNIFCNLLDKIVKRPSLQFLGQWGYHCYEPRIYRSLAKILRYVDLDGFDALLTDYIAFVEKSGYRFEVSFNLDFTEICVNTILYWVFARKGNPDFVELLLKKTKDYVQDRSCNLALIWRTFTPVYCPSPLSGITPLFYVAQTRQSNIFKILLQYGILEREKNPINIVLTIVLYPSRVRVMVDRELADIHEDAKTCLVLCSRVLSVISVKEIKTQLSLGRHPIISNWFDYIPSTRYKDPCELLHLCRLTIRNQLLTNNMLPDGIFSLLIPARLQNYLNLEI

SEQ ID NO: 5009 - protein, 466 aa, Homo sapiens
  Payload ID: 1091;
  Gene Symbol: ASB18;
  Gene Name: ankyrin repeat and SOCS box containing 18;
  Uniprot ID:  Q6ZVZ8;
  ENSP ID: ENSP00000386532
MSNSDYLPDYPLNSDLVKRLKSALDAKDEERVRDLICTEITPVDAVIELANDDWMKDPSAQLPTGMLLGDLDHLKPLMDQFFQDANVVFEINKDEMEWQVKSPATFGLSGLWTLEYKRELTTPLCIAAAHGHTACVRHLLGRGADPDASPGGRGALHEACLGGHTACVRLLLQHRADPDLLSAEGLAPLHLCRTAASLGCAQALLEHGASVQRVGGTGRDTPLHVAAQRGLDEHARLYLGRGAHVDARNGRGETALSAACGAARRPDEHGRCLRLCALLLRRGAEADARDEDERSPLHKACGHASHSLARLLLRHGADAGALDYGGASPLGRVLQTASCALQASPQRTVQALLNHGSPTVWPDAFPKVLKTCASVPAVIEVLFNSYPQLCLSESWKEVIPEEVFQMHKPFYQSLFALALTPRCLQHLCRCALRRLFGKRCFDLIPLLPLPKPLQNYLLLEPQGVLH

SEQ ID NO: 5010 - protein, 195 aa, Homo sapiens
  Payload ID: 1091;
  Gene Symbol: ASB18;
  Gene Name: ankyrin repeat and SOCS box containing 18;
  ENSP ID: ENSP00000410021
MSNSDYLPDYPLNSDLVKRLKSALDAKDEERVRDLICTEITPVDAVIELANDDWMKDPSAQLPTGMLLGLWTLEYKRELTTPLCIAAAHGHTACVRHLLGRGADPDASPGGRGALHEACLGGHTACVRLLLQHRADPDLLSAEGLAPLHLCRTAASLGCAQALLEHGASVQRVGGTGRDTPLHVAAQRGLDEHAR

SEQ ID NO: 5011 - protein, 148 aa, Homo sapiens
  Payload ID: 1091;
  Gene Symbol: ASB18;
  Gene Name: ankyrin repeat and SOCS box containing 18;
  ENSP ID: ENSP00000411434
ARDEDERSPLHKACGHASHSLARLLLRHGADAGALDYGGASPLGRVLQTASCALQASPQRTVQALLNHGSPTVWPDAFPKVLKTCASVPAVIEVLFNSYPQLCLSESWKEVIPEEVFQARGLPFCPSLVQNFCLFLLLCMGSFALIFG

SEQ ID NO: 5012 - protein, 587 aa, Homo sapiens
  Payload ID: 1092;
  Gene Symbol: ASB2;
  Gene Name: ankyrin repeat and SOCS box containing 2;
  Uniprot ID:  Q96Q27;
  ENSP ID: ENSP00000320675
MTRFSYAEYFSLFHSCSAPSRSTAPPESSPARAPMGLFQGVMQKYSSSLFKTSQLAPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGADINTQASDNASALYEACKNEHEEVVEFLLSQGADANKTNKDGLLPLHIASKKGNYRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPSSRFNDAPAADKEPSVVQFCEFVSAPEVSRWAGPIIDVLLDYVGNVQLCSRLKEHIDSFEDWAVIKEKAEPPRPLAHLCRLRVRKAIGKYRIKLLDTLPLPGRLIRYLKYENTQ

SEQ ID NO: 5013 - protein, 481 aa, Homo sapiens
  Payload ID: 1092;
  Gene Symbol: ASB2;
  Gene Name: ankyrin repeat and SOCS box containing 2;
  ENSP ID: ENSP00000450940
MRPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGADINTQASDNASALYEACKNEHEEVVEFLLSQGADANKTNKDGLLPLHIASKKGNYRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPSSRFNDAPAADKEPSVVQFCEFVSAPEVSRWAGPIIDVLLDYVGNVQLCSRLKEHIDSFEDW

SEQ ID NO: 5014 - protein, 122 aa, Homo sapiens
  Payload ID: 1092;
  Gene Symbol: ASB2;
  Gene Name: ankyrin repeat and SOCS box containing 2;
  ENSP ID: ENSP00000451355
MATQISTRGSQCTIGQEEYSLYSSLSEDELVQMAIEQSLADKTRGPTTAEATASACTNRQPAHFYPWTRPADPLIKAIKDGDEEALKTMIKEGKNLAEPNKEGWLPLHEAAYYGQVGCLKVL

SEQ ID NO: 5015 - protein, 635 aa, Homo sapiens
  Payload ID: 1092;
  Gene Symbol: ASB2;
  Gene Name: ankyrin repeat and SOCS box containing 2;
  Uniprot ID:  Q96Q27;
  ENSP ID: ENSP00000451575
MATQISTRGSQCTIGQEEYSLYSSLSEDELVQMAIEQSLADKTRGPTTAEATASACTNRQPAHFYPWTRSTAPPESSPARAPMGLFQGVMQKYSSSLFKTSQLAPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGADINTQASDNASALYEACKNEHEEVVEFLLSQGADANKTNKDGLLPLHIASKKGNYRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPSSRFNDAPAADKEPSVVQFCEFVSAPEVSRWAGPIIDVLLDYVGNVQLCSRLKEHIDSFEDWAVIKEKAEPPRPLAHLCRLRVRKAIGKYRIKLLDTLPLPGRLIRYLKYENTQ

SEQ ID NO: 5016 - protein, 111 aa, Homo sapiens
  Payload ID: 1092;
  Gene Symbol: ASB2;
  Gene Name: ankyrin repeat and SOCS box containing 2;
  ENSP ID: ENSP00000451654
MGLFQGVMQKYSSSLFKTSQLAPADPLIKAIKDGDEEALKTMIKEGKNLAEPNKEGWLPLHEAAYYGQVGCLKVLQRAYPGTIDQRTLQEETAVYLATCRGHLDCLLSLLQ

SEQ ID NO: 5017 - protein, 135 aa, Homo sapiens
  Payload ID: 1092;
  Gene Symbol: ASB2;
  Gene Name: ankyrin repeat and SOCS box containing 2;
  ENSP ID: ENSP00000451694
MRPADPLIKAIKDGDEEALKTMIKEGKNLAEPNKEGWLPLHEAAYYGQVGCLKVLQRACERKNAEAVKILVQHNADTNHRCNRGWTALHESVSRNDLEVMQILVSGGAKVESKNAYGITPLFVAAQSGQLEALRF

SEQ ID NO: 5018 - protein, 635 aa, Homo sapiens; identical to SEQ ID NO: 5015
  Payload ID: 1092;
  Gene Symbol: ASB2;
  Gene Name: ankyrin repeat and SOCS box containing 2;
  Uniprot ID:  Q96Q27;
  ENSP ID: ENSP00000480388

SEQ ID NO: 5019 - protein, 111 aa, Homo sapiens; identical to SEQ ID NO: 5016
  Payload ID: 1092;
  Gene Symbol: ASB2;
  Gene Name: ankyrin repeat and SOCS box containing 2;
  ENSP ID: ENSP00000486208

SEQ ID NO: 5020 - protein, 481 aa, Homo sapiens; identical to SEQ ID NO: 5013
  Payload ID: 1092;
  Gene Symbol: ASB2;
  Gene Name: ankyrin repeat and SOCS box containing 2;
  ENSP ID: ENSP00000486398

SEQ ID NO: 5021 - protein, 122 aa, Homo sapiens; identical to SEQ ID NO: 5014
  Payload ID: 1092;
  Gene Symbol: ASB2;
  Gene Name: ankyrin repeat and SOCS box containing 2;
  ENSP ID: ENSP00000487105

SEQ ID NO: 5022 - protein, 587 aa, Homo sapiens; identical to SEQ ID NO: 5012
  Payload ID: 1092;
  Gene Symbol: ASB2;
  Gene Name: ankyrin repeat and SOCS box containing 2;
  Uniprot ID:  Q96Q27;
  ENSP ID: ENSP00000487399

SEQ ID NO: 5023 - protein, 135 aa, Homo sapiens; identical to SEQ ID NO: 5017
  Payload ID: 1092;
  Gene Symbol: ASB2;
  Gene Name: ankyrin repeat and SOCS box containing 2;
  ENSP ID: ENSP00000487497

SEQ ID NO: 5024 - protein, 518 aa, Homo sapiens
  Payload ID: 1093;
  Gene Symbol: ASB3;
  Gene Name: ankyrin repeat and SOCS box containing 3;
  Uniprot ID:  Q9Y575;
  ENSP ID: ENSP00000263634
MDFTEAYADTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 5025 - protein, 445 aa, Homo sapiens
  Payload ID: 1093;
  Gene Symbol: ASB3;
  Gene Name: ankyrin repeat and SOCS box containing 3;
  ENSP ID: ENSP00000378206
MKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 5026 - protein, 445 aa, Homo sapiens; identical to SEQ ID NO: 5025
  Payload ID: 1093;
  Gene Symbol: ASB3;
  Gene Name: ankyrin repeat and SOCS box containing 3;
  ENSP ID: ENSP00000384728

SEQ ID NO: 5027 - protein, 477 aa, Homo sapiens
  Payload ID: 1093;
  Gene Symbol: ASB3;
  Gene Name: ankyrin repeat and SOCS box containing 3;
  ENSP ID: ENSP00000385137
  MOD_RES (1)..(1): Any amino acid
XDTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIEQGFILQKYLGPSNSQVDFLLRGELPIG

SEQ ID NO: 5028 - protein, 426 aa, Homo sapiens
  Payload ID: 1094;
  Gene Symbol: ASB4;
  Gene Name: ankyrin repeat and SOCS box containing 4;
  Uniprot ID:  Q9Y574;
  ENSP ID: ENSP00000321388
MDGTTAPVTKSGAAKLVKRNFLEALKSNDFGKLKAILIQRQIDVDTVFEVEDENMVLASYKQGYWLPSYKLKSSWATGLHLSVLFGHVECLLVLLDHNATINCRPNGKTPLHVACEMANVDCVKILCDRGAKLNCYSLSGHTALHFCTTPSSILCAKQLVWRGANVNMKTNNQDEETPLHTAAHFGLSELVAFYVEHGAIVDSVNAHMETPLAIAAYWALRFKEQEYSTEHHLVCRMLLDYKAEVNARDDDFKSPLHKAAWNCDHVLMHMMLEAGAEANLMDINGCAAIQYVLKVTSVRPAAQPEICYQLLLNHGAARIYPPQFHKVIQACHSCPKAIEVVVNAYEHIRWNTKWRRAIPDDDLEKYWDFYHSLFTVCCNSPRTLMHLSRCAIRRTLHNRCHRAIPLLSLPLSLKKYLLLEPEGIIY

SEQ ID NO: 5029 - protein, 349 aa, Homo sapiens
  Payload ID: 1094;
  Gene Symbol: ASB4;
  Gene Name: ankyrin repeat and SOCS box containing 4;
  Uniprot ID:  Q9Y574;
  ENSP ID: ENSP00000397070
MDGTTAPVTKSGAAKLVKRNFLEALKSNDFGKLKAILIQRQIDVDTVFEVEDENMVLASYKQGYWLPSYKLKSSWATGLHLSVLFGHVECLLVLLDHNATINCRPNGKTPLHVACEMANVDCVKILCDRGAKLNCYSLSGHTALHFCTTPSSILCAKQLVWRGANVNMKTNNQDEETPLHTAAHFGLSELVAFYVEHGAIVDSVNAHMETPLAIAAYWALRFKEQEYSTEHHLVCRMLLDYKAEVNARDDDFKSPLHKAAWNCDHVLMHMMLEAGAEANLMDINGCAAIQYVLKVTSVRPAAQPEICYQLLLNHGAARIYPPQFHKVRLCPVVSRLRKIQMAALSEISK

SEQ ID NO: 5030 - protein, 329 aa, Homo sapiens
  Payload ID: 1095;
  Gene Symbol: ASB5;
  Gene Name: ankyrin repeat and SOCS box containing 5;
  Uniprot ID:  Q8WWX0;
  ENSP ID: ENSP00000296525
MSVLEENRPFAQQLSNVYFTILSLFCFKLFVKISLAILSHFYIVKGNRKEAARIAAEFYGVTQGQGSWADRSPLHEAASQGRLLALRTLLSQGYNVNAVTLDHVTPLHEACLGDHVACARTLLEAGANVNAITIDGVTPLFNACSQGSPSCAELLLEYGAKAQLESCLPSPTHEAASKGHHECLDILISWGIDVDQEIPHLGTPLYVACMSQQFHCIWKLLYAGADVQKGKYWDTPLHAAAQQSSTEIVNLLLEFGADINAKNTELLRPIDVATSSSMVERILLQHEATPSSLYQLCRLCIRSYIGKPRLHLIPQLQLPTLLKNFLQYR

SEQ ID NO: 5031 - protein, 276 aa, Homo sapiens
  Payload ID: 1095;
  Gene Symbol: ASB5;
  Gene Name: ankyrin repeat and SOCS box containing 5;
  Uniprot ID:  Q8WWX0;
  ENSP ID: ENSP00000422877
MPLCNGGNLAVTGSWADRSPLHEAASQGRLLALRTLLSQGYNVNAVTLDHVTPLHEACLGDHVACARTLLEAGANVNAITIDGVTPLFNACSQGSPSCAELLLEYGAKAQLESCLPSPTHEAASKGHHECLDILISWGIDVDQEIPHLGTPLYVACMSQQFHCIWKLLYAGADVQKGKYWDTPLHAAAQQSSTEIVNLLLEFGADINAKNTELLRPIDVATSSSMVERILLQHEATPSSLYQLCRLCIRSYIGKPRLHLIPQLQLPTLLKNFLQYR

SEQ ID NO: 5032 - protein, 20 aa, Homo sapiens
  Payload ID: 1095;
  Gene Symbol: ASB5;
  Gene Name: ankyrin repeat and SOCS box containing 5;
  ENSP ID: ENSP00000423232
MSVLEENRPFAQQLSNVYFT

SEQ ID NO: 5033 - protein, 421 aa, Homo sapiens
  Payload ID: 1096;
  Gene Symbol: ASB6;
  Gene Name: ankyrin repeat and SOCS box containing 6;
  Uniprot ID:  Q9NWX5;
  ENSP ID: ENSP00000277458
MPFLHGFRRIIFEYQPLVDAILGSLGIQDPERQESLDRPSYVASEESRILVLTELLERKAHSPFYQEGVSNALLKMAELGLTRAADVLLRHGANLNFEDPVTYYTALHIAVLRNQPDMVELLVHHGADVNRRDRIHESSPLDLASEEPERLPCLQRLLDLGADVNAADKHGKTALLHALASSDGVQIHNTENIRLLLEGGADVKATTKDGDTVFTCIIFLLGETVGGDKEEAQMINRFCFQVTRLLLAHGADPSECPAHESLTHICLKSFKLHFPLLRFLLESGAAYNCSLHGASCWSGFHIIFERLCSHPGCTEDESHADLLRKAETVLDLMVTNSQKLQLPENFDIHPVGSLAEKIQALHFSLRQLESYPPPLKHLCRVAIRLYLQPWPVDVKVKALPLPDRLKWYLLSEHSGSVEDDI

SEQ ID NO: 5034 - protein, 197 aa, Homo sapiens
  Payload ID: 1096;
  Gene Symbol: ASB6;
  Gene Name: ankyrin repeat and SOCS box containing 6;
  Uniprot ID:  Q9NWX5;
  ENSP ID: ENSP00000277459
MPFLHGFRRIIFEYQPLVDAILGSLGIQDPERQESLDRPSYVASEESRILVLTELLERKAHSPFYQEGVSNALLKMAELGLTRAADVLLRHGANLNFEDPVTYYTALHIAVLRNQPDMVELLVHHGADVNRRDREKLLCSMLWPAATGCRSTILRTFVSYWKEGQTSRPPPKMGTQCSPASSSCLVRPWEGTKRRPR

SEQ ID NO: 5035 - protein, 392 aa, Homo sapiens
  Payload ID: 1096;
  Gene Symbol: ASB6;
  Gene Name: ankyrin repeat and SOCS box containing 6;
  ENSP ID: ENSP00000416172
MPFLHGFRRIIFEYQPLVDAILGSLGIQDPERQESLDRPSYVASEESRILVLTELLERKAHSPFYQEGVSNALLKMAELGLTRAADVLLRHGANLNFEDPVTYYTALHIAVLRNQPDMVELLVHHGADVNRRDRIHESSPLDLASEEPERLPCLQRLLDLGADVNAADKHGADVKATTKDGDTVFTCIIFLLGETVGGDKEEAQMINRFCFQVTRLLLAHGADPSECPAHESLTHICLKSFKLHFPLLRFLLESGAAYNCSLHGASCWSGFHIIFERLCSHPGCTEDESHADLLRKAETVLDLMVTNSQKLQLPENFDIHPVGSLAEKIQALHFSLRQLESYPPPLKHLCRVAIRLYLQPWPVDVKVKALPLPDRLKWYLLSEHSGSVEDDI

SEQ ID NO: 5036 - protein, 318 aa, Homo sapiens
  Payload ID: 1097;
  Gene Symbol: ASB7;
  Gene Name: ankyrin repeat and SOCS box containing 7;
  Uniprot ID:  Q9H672;
  ENSP ID: ENSP00000328327
MLHHHCRRNPELQEELQIQAAVAAGDVHTVRKMLEQGYSPNGRDANGWTLLHFSAARGKERCVRVFLEHGADPTVKDLIGGFTALHYAAMHGRARIARLMLESEYRSDIINAKSNDGWTPLHVAAHYGRDSFVRLLLEFKAEVDPLSDKGTTPLQLAIIRERSSCVKILLDHNANIDIQNGFLLRYAVIKSNHSYCRMFLQRGADTNLGRLEDGQTPLHLSALRDDVLCARMLYNYGADTNTRNYEGQTPLAVSISISGSSRPCLDFLQEVTRQPRNLQDLCRIKIRQCIGLQNLKLLDELPIAKVMKDYLKHKFDDI

SEQ ID NO: 5037 - protein, 274 aa, Homo sapiens
  Payload ID: 1097;
  Gene Symbol: ASB7;
  Gene Name: ankyrin repeat and SOCS box containing 7;
  Uniprot ID:  Q9H672;
  ENSP ID: ENSP00000339819
MLHHHCRRNPELQEELQIQAAVAAGDVHTVRKMLEQGYSPNGRDANGWTLLHFSAARGKERCVRVFLEHGADPTVKDLIGGFTALHYAAMHGRARIARLMLESEYRSDIINAKSNDGWTPLHVAAHYGRDSFVRLLLEFKAEVDPLSDKGTTPLQLAIIRERSSCVKILLDHNANIDIQNGFLLRYAVIKSNHSYCRMFLQRGADTNLGRLEDGQTPLHLSALRDDVLCARMLYNYGADTNTRNYEGQTPLAVSISISGSSRPCLDFLQEVTSM

SEQ ID NO: 5038 - protein, 116 aa, Homo sapiens
  Payload ID: 1097;
  Gene Symbol: ASB7;
  Gene Name: ankyrin repeat and SOCS box containing 7;
  ENSP ID: ENSP00000453626
MLHHHCRRNPELQEELQIQAAVAAGDVHTVRKMLEQGYSPNGRDANGWTLLHFSAARGKERCVRVFLEHGGQPRNLQDLCRIKIRQCIGLQNLKLLDELPIAKVMKDYLKHKFDDI

SEQ ID NO: 5039 - protein, 288 aa, Homo sapiens
  Payload ID: 1098;
  Gene Symbol: ASB8;
  Gene Name: ankyrin repeat and SOCS box containing 8;
  Uniprot ID:  Q9H765;
  ENSP ID: ENSP00000320893
MSSSMWYIMQSIQSKYSLSERLIRTIAAIRSFPHDNVEDLIRGGADVNCTHGTLKPLHCACMVSDADCVELLLEKGAEVNALDGYNRTALHYAAEKDEACVEVLLEYGANPNALDGNRDTPLHWAAFKNNAECVRALLESGASVNALDYNNDTPLSWAAMKGNLESVSILLDYGAEVRVINLIGQTPISRLVALLVRGLGTEKEDSCFELLHRAVGHFELRKNGTMPREVARDPQLCEKLTVLCSAPGTLKTLARYAVRRSLGLQYLPDAVKGLPLPASLKEYLLLLE

SEQ ID NO: 5040 - protein, 86 aa, Homo sapiens
  Payload ID: 1098;
  Gene Symbol: ASB8;
  Gene Name: ankyrin repeat and SOCS box containing 8;
  ENSP ID: ENSP00000437530
MSSSMWYIMQSIQSKYSLSERLIRTIAAIRSFPHDNVEDLIRGGADVNCTHGTLKPLHCACMVSDADCVELLLEKGAEVMFLTHSH

SEQ ID NO: 5041 - protein, 114 aa, Homo sapiens
  Payload ID: 1098;
  Gene Symbol: ASB8;
  Gene Name: ankyrin repeat and SOCS box containing 8;
  ENSP ID: ENSP00000437769
MSSSMWYIMQSIQSKYSLSERLIRTIAAIRSFPHDNVEDLIRGGADVNCTHGTLKPLHCACMVSDADCVELLLEKGAEVNALDGYNRTALHYAAEKDEACVEVLLEYGANPNAL

SEQ ID NO: 5042 - protein, 65 aa, Homo sapiens
  Payload ID: 1098;
  Gene Symbol: ASB8;
  Gene Name: ankyrin repeat and SOCS box containing 8;
  ENSP ID: ENSP00000438434
MSSSMWYIMQSIQSKYSLSERLIRTIAAIRSFPHDNVEDLIRGSMVAIESGLLVQLSCLMIREQM

SEQ ID NO: 5043 - protein, 85 aa, Homo sapiens
  Payload ID: 1098;
  Gene Symbol: ASB8;
  Gene Name: ankyrin repeat and SOCS box containing 8;
  ENSP ID: ENSP00000438498
MSSSMWYIMQSIQSKYSLSERLIRTIAAIRSFPHDNVEDLIRGGADVNCTHGTLKPLHCACMVSDADCVELLLEKGAEDSLGVAC

SEQ ID NO: 5044 - protein, 66 aa, Homo sapiens
  Payload ID: 1098;
  Gene Symbol: ASB8;
  Gene Name: ankyrin repeat and SOCS box containing 8;
  ENSP ID: ENSP00000439557
MSSSMWYIMQSIQSKYSLSERLIRTIAAIRSFPHDNVEDLIRGSMVAIESGLLVQLSCLMIRFPVL

SEQ ID NO: 5045 - protein, 85 aa, Homo sapiens; identical to SEQ ID NO: 5043
  Payload ID: 1098;
  Gene Symbol: ASB8;
  Gene Name: ankyrin repeat and SOCS box containing 8;
  ENSP ID: ENSP00000440773

SEQ ID NO: 5046 - protein, 112 aa, Homo sapiens
  Payload ID: 1098;
  Gene Symbol: ASB8;
  Gene Name: ankyrin repeat and SOCS box containing 8;
  ENSP ID: ENSP00000442639
MSSSMWYIMQSIQSKYSLSERLIRTIAAIRSFPHDNVEDLIRGGADVNCTHGTLKPLHCACMVSDADCVELLLEKGAEVNALDGYNRTALHYAAEKDEACVEVLLEYGANPN

SEQ ID NO: 5047 - protein, 95 aa, Homo sapiens
  Payload ID: 1098;
  Gene Symbol: ASB8;
  Gene Name: ankyrin repeat and SOCS box containing 8;
  ENSP ID: ENSP00000442737
MSSSMWYIMQSIQSKYSLSERLIRTIAAIRSFPHDNVEDLIRGGADVNCTHGTLKPLHCACMVSDADCVELLLEKGAELLSYLHLYHQDSLGVAC

SEQ ID NO: 5048 - protein, 86 aa, Homo sapiens; identical to SEQ ID NO: 5040
  Payload ID: 1098;
  Gene Symbol: ASB8;
  Gene Name: ankyrin repeat and SOCS box containing 8;
  ENSP ID: ENSP00000443148

SEQ ID NO: 5049 - protein, 66 aa, Homo sapiens; identical to SEQ ID NO: 5044
  Payload ID: 1098;
  Gene Symbol: ASB8;
  Gene Name: ankyrin repeat and SOCS box containing 8;
  ENSP ID: ENSP00000443835

SEQ ID NO: 5050 - protein, 127 aa, Homo sapiens
  Payload ID: 1098;
  Gene Symbol: ASB8;
  Gene Name: ankyrin repeat and SOCS box containing 8;
  ENSP ID: ENSP00000444093
MSSSMWYIMQSIQSKYSLSERLIRTIAAIRSFPHDNVEDLIRGGADVNCTHGTLKPLHCACMVSDADCVELLLEKGAEVNALDGYNRTALHYAAEKDEACVEVLLEYGANPNALDGNRDTPLHWAAF

SEQ ID NO: 5051 - protein, 85 aa, Homo sapiens; identical to SEQ ID NO: 5043
  Payload ID: 1098;
  Gene Symbol: ASB8;
  Gene Name: ankyrin repeat and SOCS box containing 8;
  ENSP ID: ENSP00000445540

SEQ ID NO: 5052 - protein, 288 aa, Homo sapiens; identical to SEQ ID NO: 5039
  Payload ID: 1098;
  Gene Symbol: ASB8;
  Gene Name: ankyrin repeat and SOCS box containing 8;
  Uniprot ID:  Q9H765;
  ENSP ID: ENSP00000445622

SEQ ID NO: 5053 - protein, 51 aa, Homo sapiens
  Payload ID: 1098;
  Gene Symbol: ASB8;
  Gene Name: ankyrin repeat and SOCS box containing 8;
  ENSP ID: ENSP00000447819
MSSSMWYIMQSIQSKYSLSERLIRTIAAIRSFPHDNVEDLIRGGADVNCTH

SEQ ID NO: 5054 - protein, 66 aa, Homo sapiens; identical to SEQ ID NO: 5044
  Payload ID: 1098;
  Gene Symbol: ASB8;
  Gene Name: ankyrin repeat and SOCS box containing 8;
  ENSP ID: ENSP00000486138

SEQ ID NO: 5055 - protein, 252 aa, Homo sapiens
  Payload ID: 1099;
  Gene Symbol: ASB9;
  Gene Name: ankyrin repeat and SOCS box containing 9;
  Uniprot ID:  Q96DX5;
  ENSP ID: ENSP00000369850
MDGKQGGMDGSKPAGPRDFPGIRLLSNPLMGDAVSDWSPMHEAAIHGHQLSLRNLISQGWAVNIITADHVSPLHEACLGGHLSCVKILLKHGAQVNGVTADWHTPLFNACVSGSWDCVNLLLQHGASVQPESDLASPIHEAARRAYGGNIDHKISHLGTPLYLACENQQRACVKKLLESGADVNQGKGQDSPLHAVARTASEELACLLMDFGADTQAKNAEGKRPVELVPPESPLAQLFLEREGASLPKPKP

SEQ ID NO: 5056 - protein, 262 aa, Homo sapiens
  Payload ID: 1099;
  Gene Symbol: ASB9;
  Gene Name: ankyrin repeat and SOCS box containing 9;
  Uniprot ID:  Q96DX5;
  ENSP ID: ENSP00000369852
MDGKQGGMDGSKPAGPRDFPGIRLLSNPLMGDAVSDWSPMHEAAIHGHQLSLRNLISQGWAVNIITADHVSPLHEACLGGHLSCVKILLKHGAQVNGVTADWHTPLFNACVSGSWDCVNLLLQHGASVQPESDLASPIHEAARRGHVECVNSLIAYGGNIDHKISHLGTPLYLACENQQRACVKKLLESGADVNQGKGQDSPLHAVARTASEELACLLMDFGADTQAKNAEGKRPVELVPPESPLAQLFLEREGASLPKPKP

SEQ ID NO: 5057 - protein, 294 aa, Homo sapiens
  Payload ID: 1099;
  Gene Symbol: ASB9;
  Gene Name: ankyrin repeat and SOCS box containing 9;
  Uniprot ID:  Q96DX5;
  ENSP ID: ENSP00000369855
MDGKQGGMDGSKPAGPRDFPGIRLLSNPLMGDAVSDWSPMHEAAIHGHQLSLRNLISQGWAVNIITADHVSPLHEACLGGHLSCVKILLKHGAQVNGVTADWHTPLFNACVSGSWDCVNLLLQHGASVQPESDLASPIHEAARRGHVECVNSLIAYGGNIDHKISHLGTPLYLACENQQRACVKKLLESGADVNQGKGQDSPLHAVARTASEELACLLMDFGADTQAKNAEGKRPVELVPPESPLAQLFLEREGPPSLMQLCRLRIRKCFGIQQHHKITKLVLPEDLKQFLLHL

SEQ ID NO: 5058 - protein, 262 aa, Homo sapiens; identical to SEQ ID NO: 5056
  Payload ID: 1099;
  Gene Symbol: ASB9;
  Gene Name: ankyrin repeat and SOCS box containing 9;
  Uniprot ID:  Q96DX5;
  ENSP ID: ENSP00000438943

SEQ ID NO: 5059 - protein, 211 aa, Homo sapiens
  Payload ID: 1099;
  Gene Symbol: ASB9;
  Gene Name: ankyrin repeat and SOCS box containing 9;
  ENSP ID: ENSP00000473542
  MOD_RES (1)..(1): Any amino acid
XKILLKHGAQVNGVTADWHTPLFNACVSGSWDCVNLLLQHGASVQPESDLASPIHEAARRGHVECVNSLIAYGGNIDHKISHLGTPLYLACENQQRACVKKLLESGADVNQGKGQDSPLHAVARTASEELACLLMDFGADTQAKNAEGKRPVELVPPESPLAQLFLEREDGVTLCRPGWSAVARSRLIATSASRNSDKMCSPGQQSFMLLV

SEQ ID NO: 5060 - protein, 1134 aa, Homo sapiens
  Payload ID: 1100;
  Gene Symbol: ANKS1A;
  Gene Name: ankyrin repeat and sterile alpha motif domain containing 1A;
  Uniprot ID:  Q92625;
  ENSP ID: ENSP00000353518
MGKEQELLEAARTGHLPAVEKLLSGKRLSSGFGGGGGGGSGGGGGGSGGGGGGLGSSSHPLSSLLSMWRGPNVNCVDSTGYTPLHHAALNGHKDVVEVLLRNDALTNVADSKGCYPLHLAAWKGDAQIVRLLIHQGPSHTRVNEQNNDNETALHCAAQYGHTEVVKVLLEELTDPTMRNNKFETPLDLAALYGRLEVVKMLLNAHPNLLSCNTKKHTPLHLAARNGHKAVVQVLLDAGMDSNYQTEMGSALHEAALFGKTDVVQILLAAGTDVNIKDNHGLTALDTVRELPSQKSQQIAALIEDHMTGKRSTKEVDKTPPPQPPLISSMDSISQKSQGDVEKAVTELIIDFDANAEEEGPYEALYNAISCHSLDSMASGRSSDQDSTNKEAEAAGVKPAGVRPRERPPPPAKPPPDEEEEDHIDKKYFPLTASEVLSMRPRIHGSAAREEDEHPYELLLTAETKKVVLVDGKTKDHRRSSSSRSQDSAEGQDGQVPEQFSGLLHGSSPVCEVGQDPFQLLCTAGQSHPDGSPQQGACHKASMQLEETGVHAPGASQPSALDQSKRVGYLTGLPTTNSRSHPETLTHTASPHPGGAEEGDRSGARSRAPPTSKPKAELKLSRSLSKSDSDLLTCSPTEDATMGSRSESLSNCSIGKKRLEKSPSFASEWDEIEKIMSSIGEGIDFSQERQKISGLRTLEQSVGEWLESIGLQQYESKLLLNGFDDVHFLGSNVMEEQDLRDIGISDPQHRRKLLQAARSLPKVKALGYDGNSPPSVPSWLDSLGLQDYVHSFLSSGYSSIDTVKNLWELELVNVLKVQLLGHRKRIIASLADRPYEEPPQKPPRFSQLRCQDLLSQTSSPLSQNDSCTGRSADLLLPPGDTGRRRHDSLHDPAAPSRAERFRIQEEHREAKLTLRPPSLAAPYAPVQSWQHQPEKLIFESCGYEANYLGSMLIKDLRGTESTQDACAKMRKSTEHMKKIPTIILSITYKGVKFIDASNKNVIAEHEIRNISCAAQDPEDLCTFAYITKDLQTSHHYCHVFSTVDVNLTYEIILTLGQAFEVAYQLALQAQKSRATGASAAEMIETKSSKPVPKPRVGVRKSALEPPDMDQDAQSHASVSWVVDPKPDSKRSLSTN

SEQ ID NO: 5061 - protein, 289 aa, Homo sapiens
  Payload ID: 1101;
  Gene Symbol: ANKS1B;
  Gene Name: ankyrin repeat and sterile alpha motif domain containing 1B;
  ENSP ID: ENSP00000331256
MQGDARRRRNENYFDDIPRSKLERQMAQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVIDPSEQKTLANLPWIVEPGQEAKRGINTKYETTIF

SEQ ID NO: 5062 - protein, 332 aa, Homo sapiens
  Payload ID: 1101;
  Gene Symbol: ANKS1B;
  Gene Name: ankyrin repeat and sterile alpha motif domain containing 1B;
  ENSP ID: ENSP00000331381
SIWRGPNVNCTDSSGYTALHHAALNGHKDIVLKLLQYEASTNVADNKGYFPIHLAAWKGDVEIVKILIHHGPSHSRVNEQNNENETALHCAAQYGHSEVVAVLLEELTDPTIRNSKLETPLDLAALYGRLRVVKMIISAHPNLMSCNTRKHTPLHLAARNGHKAVVQVLLEAGMDVSCQTEKGSALHEAALFGKVDVVRVLLETGIDANIKDSLGRTVLDILKEHPSQKSLQIATLLQEYLEGVGRSTVLEEPVQEDATQETHISSPVESPSQKTKSETVTGELSKLLDEIKLCQEKDYSFEDLCHTISDHYLDNLSKISEEELGKNGSQSV

SEQ ID NO: 5063 - protein, 254 aa, Homo sapiens
  Payload ID: 1101;
  Gene Symbol: ANKS1B;
  Gene Name: ankyrin repeat and sterile alpha motif domain containing 1B;
  Uniprot ID:  Q7Z6G8;
  ENSP ID: ENSP00000345510
MQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 5064 - protein, 357 aa, Homo sapiens
  Payload ID: 1101;
  Gene Symbol: ANKS1B;
  Gene Name: ankyrin repeat and sterile alpha motif domain containing 1B;
  Uniprot ID:  Q7Z6G8;
  ENSP ID: ENSP00000447312
MANGFDNVQFMGSNVMEDQDLLEIGILNSGHRQRILQAIQLLPKMRPIGHDGYHPTSVAEWLDSIELGDYTKAFLINGYTSMDLLKKIWEVELINQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVIDPSEQKTLANLPWIVEPGQEAKRGINTKYETTIF

SEQ ID NO: 5065 - protein, 460 aa, Homo sapiens
  Payload ID: 1101;
  Gene Symbol: ANKS1B;
  Gene Name: ankyrin repeat and sterile alpha motif domain containing 1B;
  Uniprot ID:  Q7Z6G8;
  ENSP ID: ENSP00000447839
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVPFCFKADRPI

SEQ ID NO: 5066 - protein, 450 aa, Homo sapiens
  Payload ID: 1101;
  Gene Symbol: ANKS1B;
  Gene Name: ankyrin repeat and sterile alpha motif domain containing 1B;
  Uniprot ID:  Q7Z6G8;
  ENSP ID: ENSP00000447999
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 5067 - protein, 510 aa, Homo sapiens
  Payload ID: 1101;
  Gene Symbol: ANKS1B;
  Gene Name: ankyrin repeat and sterile alpha motif domain containing 1B;
  Uniprot ID:  Q7Z6G8;
  ENSP ID: ENSP00000448203
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 5068 - protein, 426 aa, Homo sapiens
  Payload ID: 1101;
  Gene Symbol: ANKS1B;
  Gene Name: ankyrin repeat and sterile alpha motif domain containing 1B;
  Uniprot ID:  Q7Z6G8;
  ENSP ID: ENSP00000448205
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 5069 - protein, 764 aa, Homo sapiens
  Payload ID: 1101;
  Gene Symbol: ANKS1B;
  Gene Name: ankyrin repeat and sterile alpha motif domain containing 1B;
  Uniprot ID:  Q7Z6G8;
  ENSP ID: ENSP00000448512
MLAQESYPKKRNYTMEIVPSASLDTFPSENENFLCDLMDTAVTKKPCSLEIARAPSPRTDNASEVAVTTPGTSNHRNSSTGPTPDCSPPSPDTALKNIVKVIRPQPKQRTSIVSSLDFHRMNHNQEYFEINTSTGCTSFTASPPASPPTSSVGTTEVKNEGTNHTDDLSRQDDNDPPKEYDPGQFAGLLHGSSPACESPENPFHLYGKREQCEKGQDEVSLANSPLPFKQSPIENNSEPLVKKIKPKVVSRTIFHKKSNQLENHTIVGTRSTRSGSRNGDQWVMNAGGFVERACTLGRIRSLPKALIDMHLSKSVSKSDSDLIAYPSNEKTSRVNWSESSTAEHSSKGNSERTPSFTSEWEEIDKIMSSIDVGINNELKEMNGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 5070 - protein, 532 aa, Homo sapiens
  Payload ID: 1101;
  Gene Symbol: ANKS1B;
  Gene Name: ankyrin repeat and sterile alpha motif domain containing 1B;
  ENSP ID: ENSP00000448744
  MOD_RES (1)..(1): Any amino acid
XHLSKSVSKSDSDLIAYPSNEKTSRVNWSESSTAEHSSKGNSERTPSFTSEWEEIDKIMSSIDVGINNELKEMNGETTRPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 5071 - protein, 414 aa, Homo sapiens
  Payload ID: 1101;
  Gene Symbol: ANKS1B;
  Gene Name: ankyrin repeat and sterile alpha motif domain containing 1B;
  Uniprot ID:  Q7Z6G8;
  ENSP ID: ENSP00000448993
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 5072 - protein, 1248 aa, Homo sapiens
  Payload ID: 1101;
  Gene Symbol: ANKS1B;
  Gene Name: ankyrin repeat and sterile alpha motif domain containing 1B;
  Uniprot ID:  Q7Z6G8;
  ENSP ID: ENSP00000449629
MGKDQELLEAARTGNVALVEKLLSGRKGGILGGGSGPLPLSNLLSIWRGPNVNCTDSSGYTALHHAALNGHKDIVLKLLQYEASTNVADNKGYFPIHLAAWKGDVEIVKILIHHGPSHSRVNEQNNENETALHCAAQYGHSEVVAVLLEELTDPTIRNSKLETPLDLAALYGRLRVVKMIISAHPNLMSCNTRKHTPLHLAARNGHKAVVQVLLEAGMDVSCQTEKGSALHEAALFGKVDVVRVLLETGIDANIKDSLGRTVLDILKEHPSQKSLQIATLLQEYLEGVGRSTVLEEPVQEDATQETHISSPVESPSQKTKSETVTGELSKLLDEIKLCQEKDYSFEDLCHTISDHYLDNLSKISEEELGKNGSQSVRTSSTINLSPGEVEEEDDDENTCGPSGLWEALTPCNGCRNLGFPMLAQESYPKKRNYTMEIVPSASLDTFPSENENFLCDLMDTAVTKKPCSLEIARAPSPRTDNASEVAVTTPGTSNHRNSSTGPTPDCSPPSPDTALKNIVKVIRPQPKQRTSIVSSLDFHRMNHNQEYFEINTSTGCTSFTASPPASPPTSSVGTTEVKNEGTNHTDDLSRQDDNDPPKEYDPGQFAGLLHGSSPACESPENPFHLYGKREQCEKGQDEVSLANSPLPFKQSPIENNSEPLVKKIKPKVVSRTIFHKKSNQLENHTIVGTRSTRSGSRNGDQWVMNAGGFVERACTLGRIRSLPKALIDMHLSKSVSKSDSDLIAYPSNEKTSRVNWSESSTAEHSSKGNSERTPSFTSEWEEIDKIMSSIDVGINNELKEMNGETTRPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 5073 - protein, 562 aa, Homo sapiens
  Payload ID: 1101;
  Gene Symbol: ANKS1B;
  Gene Name: ankyrin repeat and sterile alpha motif domain containing 1B;
  ENSP ID: ENSP00000449894
MGKDQELLEAARTGNVALVEKLLSGRKGGILGGGSGPLPLSNLLSIWRGPNVNCTDSSGYTALHHAALNGHKDIVLKLLQYEASTNVADNKGYFPIHLAAWKGDVEIVKILIHHGPSHSRVNEQNNENETALHCAAQYGHSEVVAVLLEELTDPTIRNSKLETPLDLAALYGRLRVVKMIISAHPNLMSCNTRKHTPLHLAARNGHKAVVQVLLEAGMDVSCQTEKGSALHEAALFGKVDVVRVLLETEYLEGVGRSTVLEEPVQEDATQETHISSPVESPSQKTKSETVTGELSKLLDEIKLCQEKDYSFEDLCHTISDHYLDNLSKISEEELGKNGSQSVRTSSTINLSPGEVEEEDDDENTCGPSGLWEALTPCNGCRNLGFPMLAQESYPKKRNYTMEIVPSASLDTFPSENENFLCDLMDTAVTKKPCSLEIARAPSPRTDNASEVAVTTPGTSNHRNSSTGPTPDCSPPSPDTALKNIVKVIRPQPKQRTSIVSSLDFHRMNHNQEYFEINTSTGCTSFTASPPASPPTSSVGTTEVKNEGTNHTDDLSRQDDNDP

SEQ ID NO: 5074 - protein, 394 aa, Homo sapiens
  Payload ID: 1101;
  Gene Symbol: ANKS1B;
  Gene Name: ankyrin repeat and sterile alpha motif domain containing 1B;
  Uniprot ID:  Q7Z6G8;
  ENSP ID: ENSP00000450015
MGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVIDPSEQKTLANLPWIVEPGQEAKRGINTKYETTIF

SEQ ID NO: 5075 - protein, 52 aa, Homo sapiens
  Payload ID: 1101;
  Gene Symbol: ANKS1B;
  Gene Name: ankyrin repeat and sterile alpha motif domain containing 1B;
  ENSP ID: ENSP00000452523
  MOD_RES (1)..(1): Any amino acid
XSSTLPESFENKPSKPIPKPRVSIRKSVDLLHASHTGQEPSERHTEEALRKF

SEQ ID NO: 5076 - protein, 107 aa, Homo sapiens
  Payload ID: 1101;
  Gene Symbol: ANKS1B;
  Gene Name: ankyrin repeat and sterile alpha motif domain containing 1B;
  ENSP ID: ENSP00000473277
MQGDARRRRNENYFDDIPRSKLERQMAQTGDWGEPSITLRPPNEATASTPVQYWQHHPEKLIFQSCDYKAFYLGSMLIKELRGTESTQDACAKMRLSNFNFRSLQSK

SEQ ID NO: 5077 - protein, 95 aa, Homo sapiens
  Payload ID: 1101;
  Gene Symbol: ANKS1B;
  Gene Name: ankyrin repeat and sterile alpha motif domain containing 1B;
  ENSP ID: ENSP00000473300
MAQQSSVCEIWTNQNAGFPFSAIHQVHNTGDWGEPSITLRPPNEATASTPVQYWQHHPEKLIFQSCDYKAFYLGSMLIKELRGTESTQDACAKMR

SEQ ID NO: 5078 - protein, 96 aa, Homo sapiens
  Payload ID: 1101;
  Gene Symbol: ANKS1B;
  Gene Name: ankyrin repeat and sterile alpha motif domain containing 1B;
  ENSP ID: ENSP00000473331
MQGDARRRRNENYFDDIPRSKLERQMAQTGDWGEPSITLRPPNEATASTPVQYWQHHPEKLIFQSCDYKAFYLGSMLIKELRGTESTQDACAKMRV

SEQ ID NO: 5079 - protein, 39 aa, Homo sapiens
  Payload ID: 1101;
  Gene Symbol: ANKS1B;
  Gene Name: ankyrin repeat and sterile alpha motif domain containing 1B;
  ENSP ID: ENSP00000473434
MQGDARRRRNENYFDDIPRSKLERQMAQTGDWGEPSITL

SEQ ID NO: 5080 - protein, 20 aa, Homo sapiens
  Payload ID: 1101;
  Gene Symbol: ANKS1B;
  Gene Name: ankyrin repeat and sterile alpha motif domain containing 1B;
  ENSP ID: ENSP00000473513
MLIKELRGTESTQDACAKMR

SEQ ID NO: 5081 - protein, 27 aa, Homo sapiens
  Payload ID: 1101;
  Gene Symbol: ANKS1B;
  Gene Name: ankyrin repeat and sterile alpha motif domain containing 1B;
  ENSP ID: ENSP00000473517
MQGDARRRRNENYFDDIPRSKLERQMA

SEQ ID NO: 5082 - protein, 151 aa, Homo sapiens
  Payload ID: 1101;
  Gene Symbol: ANKS1B;
  Gene Name: ankyrin repeat and sterile alpha motif domain containing 1B;
  ENSP ID: ENSP00000473522
MQGDARRRRNENYFDDIPRSKLERQMAQSSVCEIWTNQNAGFPFSAIHQVHNTGDWGEPSITLRPPNEATASTPVQYWQHHPEKLIFQSCDYKAFYLGSMLIKELRGTESTQDACAKMRGKEKSTEQMKKVPTIILSVSYKGVKFIDATNK

SEQ ID NO: 5083 - protein, 64 aa, Homo sapiens
  Payload ID: 1101;
  Gene Symbol: ANKS1B;
  Gene Name: ankyrin repeat and sterile alpha motif domain containing 1B;
  ENSP ID: ENSP00000473673
MQGDARRRRNENYFDDIPRSKLERQMAQSSVCEIWTNQNAGFPFSAIHQVHNTGDWGEPSITLR

SEQ ID NO: 5084 - protein, 656 aa, Homo sapiens
  Payload ID: 1102;
  Gene Symbol: ANKS3;
  Gene Name: ankyrin repeat and sterile alpha motif domain containing 3;
  Uniprot ID:  Q6ZW76;
  ENSP ID: ENSP00000304586
MSELSDEASEPELLNRSLSMWHGLGTQVSGEELDVPLDLHTAASIGQYEVVKECVQRRELDLNKKNGGGWTPLMYASYIGHDTIVHLLLEAGVSVNVPTPEGQTPLMLASSCGNESIAYFLLQQGAELEMKDIQGWTALFHCTSAGHQHMVRFLLDSGANANVREPICGFTPLMEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRAATDREGFLAESSPQTQRAPYSGPQDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPADSKGWQASLQAMSLPELSGALEDRVREMGQALCLVTQSLEKLQVLNGKKWRET

SEQ ID NO: 5085 - protein, 549 aa, Homo sapiens
  Payload ID: 1102;
  Gene Symbol: ANKS3;
  Gene Name: ankyrin repeat and sterile alpha motif domain containing 3;
  ENSP ID: ENSP00000388270
MSELSDEASEPELLNRSLSMWHGLGTQVSGEELDVPLDLHTAASIGQYEVVKECVQREPICGFTPLMEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRAATDREGFLAESSPQTQRAPYSGPQDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPADSKGWQASLQAMSLPELSGALEDRVREMGQALCLVTQSLEKLQVLNGKKWRET

SEQ ID NO: 5086 - protein, 527 aa, Homo sapiens
  Payload ID: 1102;
  Gene Symbol: ANKS3;
  Gene Name: ankyrin repeat and sterile alpha motif domain containing 3;
  ENSP ID: ENSP00000406796
MKDIQGWTALFHCTSAGHQHMVRFLLDSGANANVREPICGFTPLMEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRAATDREGFLAESSPQTQRAPYSGPQDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPADSKGWQASLQAMSLPELSGALEDRVREMGQALCLVTQSLEKLQVLNGKKWRET

SEQ ID NO: 5087 - protein, 61 aa, Homo sapiens
  Payload ID: 1102;
  Gene Symbol: ANKS3;
  Gene Name: ankyrin repeat and sterile alpha motif domain containing 3;
  ENSP ID: ENSP00000465203
MSELSDEASEPELLNRSLSMWHGLGTQVSGEELDVPLDLHTAASIGQYEVVKECVQRKVQS

SEQ ID NO: 5088 - protein, 583 aa, Homo sapiens
  Payload ID: 1102;
  Gene Symbol: ANKS3;
  Gene Name: ankyrin repeat and sterile alpha motif domain containing 3;
  Uniprot ID:  Q6ZW76;
  ENSP ID: ENSP00000465294
MYASYIGHDTIVHLLLEAGVSVNVPTPEGQTPLMLASSCGNESIAYFLLQQGAELEMKDIQGWTALFHCTSAGHQHMVRFLLDSGANANVREPICGFTPLMEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRAATDREGFLAESSPQTQRAPYSGPQDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPADSKGWQASLQAMSLPELSGALEDRVREMGQALCLVTQSLEKLQVLNGKKWRET

SEQ ID NO: 5089 - protein, 214 aa, Homo sapiens
  Payload ID: 1102;
  Gene Symbol: ANKS3;
  Gene Name: ankyrin repeat and sterile alpha motif domain containing 3;
  ENSP ID: ENSP00000465306
MSELSDEASEPELLNRSLSMWHGLGTQVSGEELDVPLDLHTAASIGQYEVVKECVQREPICGFTPLMEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYGSSPWLCHLQQQWREPPGRRGPLLPGCHLPHQ

SEQ ID NO: 5090 - protein, 126 aa, Homo sapiens
  Payload ID: 1102;
  Gene Symbol: ANKS3;
  Gene Name: ankyrin repeat and sterile alpha motif domain containing 3;
  ENSP ID: ENSP00000465361
MSELSDEASEPELLNRSLSMWHGLGTQVSGEELDVPLDLHTAASIGQYEVVKECVQRRELDLNKKNGGGWTPLMYASYIGHDTIVHLLLEAGVSVNVPTPEGQTPLMLASSCGNESIAYFLLQVQS

SEQ ID NO: 5091 - protein, 172 aa, Homo sapiens
  Payload ID: 1102;
  Gene Symbol: ANKS3;
  Gene Name: ankyrin repeat and sterile alpha motif domain containing 3;
  ENSP ID: ENSP00000465373
MLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHA

SEQ ID NO: 5092 - protein, 61 aa, Homo sapiens; identical to SEQ ID NO: 5087
  Payload ID: 1102;
  Gene Symbol: ANKS3;
  Gene Name: ankyrin repeat and sterile alpha motif domain containing 3;
  ENSP ID: ENSP00000465454

SEQ ID NO: 5093 - protein, 163 aa, Homo sapiens
  Payload ID: 1102;
  Gene Symbol: ANKS3;
  Gene Name: ankyrin repeat and sterile alpha motif domain containing 3;
  ENSP ID: ENSP00000465566
MSELSDEASEPELLNRSLSMWHGLGTQVSGEELDVPLDLHTAASIGQYEVVKECVQRRELDLNKKNGGGWTPLMYASYIGHDTIVHLLLEAGVSVNVPTPEGQTPLMLASSCGNESIAYFLLQQGAELEMKDIQGWTALFHCTSAGHQHMVRFLLDSGANANV

SEQ ID NO: 5094 - protein, 80 aa, Homo sapiens
  Payload ID: 1102;
  Gene Symbol: ANKS3;
  Gene Name: ankyrin repeat and sterile alpha motif domain containing 3;
  ENSP ID: ENSP00000466162
MSELSDEASEPELLNRSLSMWHGLGTQVSGEELDVPLDLHTAASIGQYEVVKECVQRESRWTRETTVEPQPGCWPSSTDT

SEQ ID NO: 5095 - protein, 318 aa, Homo sapiens
  Payload ID: 1102;
  Gene Symbol: ANKS3;
  Gene Name: ankyrin repeat and sterile alpha motif domain containing 3;
  ENSP ID: ENSP00000466228
MSELSDEASEPELLNRSLSMWHGLGTQVSGEELDVPLDLHTAASIGQYEVVKECVQREPICGFTPLMEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRAATDREGFLAESSPQTQRAPYS

SEQ ID NO: 5096 - protein, 133 aa, Homo sapiens
  Payload ID: 1102;
  Gene Symbol: ANKS3;
  Gene Name: ankyrin repeat and sterile alpha motif domain containing 3;
  ENSP ID: ENSP00000466362
MSELSDEASEPELLNRSLSMWHGLGTQVSGEELDVPLDLHTAASIGQYEVVKECVQREPICGFTPLMEAAAAGHEIIVQYFLNHGVKVDARDHSGATARMLAKQYGHMKIVALMDTYSPSLPKSLYRSPEKYE

SEQ ID NO: 5097 - protein, 289 aa, Homo sapiens
  Payload ID: 1102;
  Gene Symbol: ANKS3;
  Gene Name: ankyrin repeat and sterile alpha motif domain containing 3;
  ENSP ID: ENSP00000467439
  MOD_RES (1)..(1): Any amino acid
XLTSPALLLRDRGLAGRRVSASTRDREPWPGSQALAWAAEPHGLAMSRLLPVAMSPSTAVARTPWKKRASAAGMSPPPSMSGMWRAAAAAAVGDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPADSKGWQASLQAMSLPELSGAL

SEQ ID NO: 5098 - protein, 61 aa, Homo sapiens; identical to SEQ ID NO: 5087
  Payload ID: 1102;
  Gene Symbol: ANKS3;
  Gene Name: ankyrin repeat and sterile alpha motif domain containing 3;
  ENSP ID: ENSP00000467474

SEQ ID NO: 5099 - protein, 140 aa, Homo sapiens
  Payload ID: 1102;
  Gene Symbol: ANKS3;
  Gene Name: ankyrin repeat and sterile alpha motif domain containing 3;
  ENSP ID: ENSP00000467591
MSELSDEASEPELLNRSLSMWHGLGTQVSGEELDVPLDLHTAASIGQYEVVKECVQRRELDLNKKNGGGWTPLMYASYIGHDTIVHLLLEAGVSVNVPTPEGQTPLMLASSCGNESIAYFLLQGADMWIYSLDGSSCCWP

SEQ ID NO: 5100 - protein, 108 aa, Homo sapiens
  Payload ID: 1102;
  Gene Symbol: ANKS3;
  Gene Name: ankyrin repeat and sterile alpha motif domain containing 3;
  ENSP ID: ENSP00000467783
MLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLC

SEQ ID NO: 5101 - protein, 255 aa, Homo sapiens
  Payload ID: 1102;
  Gene Symbol: ANKS3;
  Gene Name: ankyrin repeat and sterile alpha motif domain containing 3;
  ENSP ID: ENSP00000468234
MEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRAATDREGFLAESSPQTQRAPYSGPQ

SEQ ID NO: 5102 - protein, 166 aa, Homo sapiens
  Payload ID: 1102;
  Gene Symbol: ANKS3;
  Gene Name: ankyrin repeat and sterile alpha motif domain containing 3;
  ENSP ID: ENSP00000468380
MSELSDEASEPELLNRSLSMWHGLGTQVSGEELDVPLDLHTAASIGQYEVVKECVQRRELDLNKKNGGGWTPLMYASYIGHDTIVHLLLEAGVSVNVPTPEGQTPLMLASSCGNESIAYFLLQQGAELEMKDIQGWTALFHCTSAGHQHMVRFLLDSGANANVREP

SEQ ID NO: 5103 - protein, 114 aa, Homo sapiens
  Payload ID: 1102;
  Gene Symbol: ANKS3;
  Gene Name: ankyrin repeat and sterile alpha motif domain containing 3;
  ENSP ID: ENSP00000468464
MSELSDEASEPELLNRSLSMWHGLGTQVSGEELDVPLDLHTAASIGQYEVVKECVQREPICGFTPLMEAAAAGHEIIVQYFLNHSPSVAQAGVQQLTAISASRVEAILLPQPPE

SEQ ID NO: 5104 - protein, 656 aa, Homo sapiens; identical to SEQ ID NO: 5084
  Payload ID: 1102;
  Gene Symbol: ANKS3;
  Gene Name: ankyrin repeat and sterile alpha motif domain containing 3;
  Uniprot ID:  Q6ZW76;
  ENSP ID: ENSP00000480350

SEQ ID NO: 5105 - protein, 417 aa, Homo sapiens
  Payload ID: 1103;
  Gene Symbol: ANKS4B;
  Gene Name: ankyrin repeat and sterile alpha motif domain containing 4B;
  Uniprot ID:  Q8N8V4;
  ENSP ID: ENSP00000308772
MSTRYHQAASDSYLELLKEATKRDLNLSDEDGMTPTLLAAYHGNLEALEIICSRGGDPDRCDIWGNTPLHFAASNGHAHCVSFLVNFGANIFALDNDLQTPLDAAASREQNECVALLDKAATAQNIMNPKKVTRLKEQAQKNARRQIKECERLQEKHQNKMAHTYSKEESGTLSSSKGTFSRSSPSNASAPGTFGSLSKGIKDTFKIKFKKNKDTAEQVGKEGRSGQRNVMEVFREEEEDSFSGDFKEKLQLSAEEDGSVHHESILNRPGLGSIVFRRNRISSPEDISDSKREFGFKLPSELLQRQGASEADEGAADEEGEENGLKDDLPWDDDEVEWEEDVVDATPLEVFLLSQHLEEFLPIFKREQIDLEALLLCSDEDLQSIQMQLGPRKKVLNAINRRKQVLQQPGQLVDTSL

SEQ ID NO: 5106 - protein, 871 aa, Homo sapiens
  Payload ID: 1104;
  Gene Symbol: ANKS6;
  Gene Name: ankyrin repeat and sterile alpha motif domain containing 6;
  Uniprot ID:  Q68DC2;
  ENSP ID: ENSP00000297837
MGEGGLPPAFQLLLRACDQGDTETARRLLEPGAAEPAERGAEPEAGAEPAGAEVAGPGAAAAGAVGAPVPVDCSDEAGNTALQFAAAGGHEPLVRFLLRRGASVNSRNHYGWSALMQAARFGHVSVAHLLLDHGADVNAQNRLGASVLTVASRGGHLGVVKLLLEAGAFVDHHHPSGEQLGLGGSRDEPLDITALMAAIQHGHEAVVRLLMEWGADPNHAARTVGWSPLMLAALTGRLGVAQQLVEKGANPDHLSVLEKTAFEVALDCKHRDLVDYLDPLTTVRPKTDEEKRRPDIFHALKMGNFQLVKEIADEDPSHVNLVNGDGATPLMLAAVTGQLALVQLLVERHADVDKQDSVHGWTALMQATYHGNKEIVKYLLNQGADVTLRAKNGYTAFDLVMLLNDPDTELVRLLASVCMQVNKDKGRPSHQPPLPHSKVRQPWSIPVLPDDKGGLKSWWNRMSNRFRKLKLMQTLPRGLSSNQPLPFSDEPEPALDSTMRAAPQDKTSRSALPDAAPVTKDNGPGSTRGEKEDTLLTTMLRNGAPLTRLPSDKLKAVIPPFLPPSSFELWSSDRSRTRHNGKADPMKTALPQRASRGHPVGGGGTDTTPVRPVKFPSLPRSPASSANSGNFNHSPHSSGGSSGVGVSRHGGELLNRSGGSIDNVLSQIAAQRKKAAGLLEQKPSHRSSPVGPAPGSSPSELPASPAGGSAPVGKKLETSKRPPSGTSTTSKSTSPTLTPSPSPKGHTAESSVSSSSSHRQSKSSGGSSSGTITDEDELTGILKKLSLEKYQPIFEEQEVDMEAFLTLTDGDLKELGIKTDGSRQQILAAISELNAGKGRERQILQETIHNFHSSFESSASNTRAPGNSPCA

SEQ ID NO: 5107 - protein, 584 aa, Homo sapiens
  Payload ID: 1104;
  Gene Symbol: ANKS6;
  Gene Name: ankyrin repeat and sterile alpha motif domain containing 6;
  ENSP ID: ENSP00000364159
MGNFQLVKEIADEDPSHVNLVNGDGATPLMLAAVTGQLALVQLLVERHADVDKQDSVHGWTALMQATYHGNKEIVKYLLNQGADVTLRAKNGYTAFDLVMLLNDPDTELVRLLASVCMQVNKDKGRPSHQPPLPHSKVRQPWSIPVLPDDKGGLKSWWNRMSNRFRKLKLMQTLPRGLSSNQPLPFSDEPEPALDSTMRAAPQDKTSRSALPDAAPVTKDNGPGSTRGEKEDTLLTTMLRNGAPLTRLPSDKLKAVIPPFLPPSSFELWSSDRSRTRHNGKADPMKTALPQRASRGHPVGGGGTDTTPVRPVKFPSLPRSPASSANSGNFNHSPHSSGGSSGVGVSRHGGELLNRSGGSIDNVLSQIAAQRKKAAGLLEQKPSHRSSPVGPAPGSSPSELPASPAGGSAPVGKKLETSKRPPSGTSTTSKSTSPTLTPSPSPKGHTAESSVSSSSSHRQSKSSGGSSSGTITDEDELTGILKKLSLEKYQPIFEEQEVDMEAFLTLTDGDLKELGIKTDGSRQQILAAISELNAGKGRERQILQETIHNFHSSFESSASNTRAPGNSPSMVGWVRPEETASGKR

SEQ ID NO: 5108 - protein, 341 aa, Homo sapiens
  Payload ID: 1104;
  Gene Symbol: ANKS6;
  Gene Name: ankyrin repeat and sterile alpha motif domain containing 6;
  ENSP ID: ENSP00000398648
  MOD_RES (1)..(1): Any amino acid
XDTLLTTMLRNGAPLTRLPSDKLKAVIPPFLPPSSFELWSSDRSRTRHNGKADPMKTALPQRASRGHPVGGGGTDTTPVRPVKFPSLPRSPASSANSGNFNHSPHSSGGSSGVGVSRHGGELLNRSGGSIDNVLSQIAAQRKKAAGLLEQKPSHRSSPVGPAPGSSPSELPASPAGGSAPVGKQKLETSKRPPSGTSTTSKSTSPTLTPSPSPKGHTAESSVSSSSSHRQSKSSGGSSSGTITDEDELTGILKKLSLEKYQPIFEEQEVDMEAFLTLTDGDLKELGIKTDGSRQQILAAISELNAGKGRERQILQETIHNFHSSFESSASNTRAPGNSPCA

SEQ ID NO: 5109 - protein, 544 aa, Homo sapiens
  Payload ID: 1105;
  Gene Symbol: ANKUB1;
  Gene Name: ankyrin repeat and ubiquitin domain containing 1;
  ENSP ID: ENSP00000387907
MRIFIAFEGSFEPFDVSADETVEVVKLMIKDYFHIPLSEDKQGRRYLELMYAGAALKDSWSLADVGISFCSTLKCFVKEEDKPTLYVFNAVTQDTMPVMESISLLDKTVSDLRTLVTLRCGLPVSVYCLRTPRGLEMYDCNTLKDYQTDIGTTLRLDVWDGWKEFLMGCLLGQKLKVQRYLSKEGPVLKYQKRVALYIAAFCGYIELTEWALKQGARPHEAVGVHPYRAWCHEALHADVSKCPIHAAAEAGQLLILKAFVNYSVLCLECKNAAGQTPLTIVFKHKHKDCVLYLLSKMWSTVSFPKISVPMRIYIKIKQWILRAQSHSLHKSQFCGARVFGAKVGDTVMVDGFTKPKMTSKSWHKAGNSDSQSIVLKLPSLSKQTASSKPVNPLAISQPDTRKQALKFHPLVNASSFSELQKHQQQNQKKITATARKKEKLIKNTYLPQVPLPPVSRVGYSHPSFFYATPSADFLLKSSFSSFLEHSGKTPWENAIYCLAVASAFKEKRWLQQLEIARVLAKKSISNLTTRGGLTACENSLETVL

SEQ ID NO: 5110 - protein, 502 aa, Homo sapiens
  Payload ID: 1105;
  Gene Symbol: ANKUB1;
  Gene Name: ankyrin repeat and ubiquitin domain containing 1;
  Uniprot ID:  A6NFN9;
  ENSP ID: ENSP00000417635
MRIFIAFEGSFEPFDVSADETVEVVKLMIKDYFHIPLSEDKQGRRYLELMYAGAALKDSWSLADVGISFCSTLKCFVKEEDKPTLYVFNAVTQDTMPVMESISLLDKTVSDLRTLVTLRCGLPVSVYCLRTPRGLEMYDCNTLKDYQTDIGTTLRLDVWDGWKEFLMGCLLGQKLKVQRYLSKEGPVLKYQKRVALYIAAFCGYIELTEWALKQGARPHEAVGVHPYRAWCHEALHADVSKCPIHAAAEAGQLLILKAFVNYSVLCLECKNAAGQTPLTIVFKHKHKDCVLYLLSKMWSTVSFPKISVPMRIYIKIKQWILRAQSHSLHKSQFCGARVFGAKVGDTVMVDGFTKPKMTSKSWHKAGNSDSQSIVLKLPSLSKQTASSKPVNPLAISQPDTRKQALKFHPLVNASSFSELQKHQQQNQKKITATARKKEKLIKNTYLPQVPLPPVSRVGYSHPSFFYATPSADFLLKSSFSSFLEHSGKTPWENAIYCLAVAR

SEQ ID NO: 5111 - protein, 39 aa, Homo sapiens
  Payload ID: 1105;
  Gene Symbol: ANKUB1;
  Gene Name: ankyrin repeat and ubiquitin domain containing 1;
  ENSP ID: ENSP00000420428
MRIFIAFEGSFEPFDVSADETVEVVKLMIKTNKAGGIWS

SEQ ID NO: 5112 - protein, 726 aa, Homo sapiens
  Payload ID: 1106;
  Gene Symbol: ANKZF1;
  Gene Name: ankyrin repeat and zinc finger domain containing 1;
  Uniprot ID:  Q9H8Y5;
  ENSP ID: ENSP00000321617
MSPAPDAAPAPASISLFDLSADAPVFQGLSLVSHAPGEALARAPRTSCSGSGERESPERKLLQGPMDISEKLFCSTCDQTFQNHQEQREHYKLDWHRFNLKQRLKDKPLLSALDFEKQSSTGDLSSISGSEDSDSASEEDLQTLDRERATFEKLSRPPGFYPHRVLFQNAQGQFLYAYRCVLGPHQDPPEEAELLLQNLQSRGPRDCVVLMAAAGHFAGAIFQGREVVTHKTFHRYTVRAKRGTAQGLRDARGGPSHSAGANLRRYNEATLYKDVRDLLAGPSWAKALEEAGTILLRAPRSGRSLFFGGKGAPLQRGDPRLWDIPLATRRPTFQELQRVLHKLTTLHVYEEDPREAVRLHSPQTHWKTVREERKKPTEEEIRKICRDEKEALGQNEESPKQGSGSEGEDGFQVELELVELTVGTLDLCESEVLPKRRRRKRNKKEKSRDQEAGAHRTLLQQTQEEEPSTQSSQAVAAPLGPLLDEAKAPGQPELWNALLAACRAGDVGVLKLQLAPSPADPRVLSLLSAPLGSGGFTLLHAAAAAGRGSVVRLLLEAGADPTVQDSRARPPYTVAADKSTRNEFRRFMEKNPDAYDYNKAQVPGPLTPEMEARQATRKREQKAARRQREEQQQRQQEQEEREREEQRRFAALSDREKRALAAERRLAAQLGAPTSPIPDSAIVNTRRCWSCGASLQGLTPFHYLDFSFCSTRCLQDHRRQAGRPSS

SEQ ID NO: 5113 - protein, 726 aa, Homo sapiens; identical to SEQ ID NO: 5112
  Payload ID: 1106;
  Gene Symbol: ANKZF1;
  Gene Name: ankyrin repeat and zinc finger domain containing 1;
  Uniprot ID:  Q9H8Y5;
  ENSP ID: ENSP00000386337

SEQ ID NO: 5114 - protein, 516 aa, Homo sapiens
  Payload ID: 1106;
  Gene Symbol: ANKZF1;
  Gene Name: ankyrin repeat and zinc finger domain containing 1;
  ENSP ID: ENSP00000386815
MAAAGHFAGAIFQGREVVTHKTFHRYTVRAKRGTAQGLRDARGGPSHSAGANLRRYNEATLYKDVRDLLAGPSWAKALEEAGTILLRAPRSGRSLFFGGKGAPLQRGDPRLWDIPLATRRPTFQELQRVLHKLTTLHVYEEDPREAVRLHSPQTHWKTVREERKKPTEEEIRKICRDEKEALGQNEESPKQGSGSEGEDGFQVELELVELTVGTLDLCESEVLPKRRRRKRNKKEKSRDQEAGAHRTLLQQTQEEEPSTQSSQAVAAPLGPLLDEAKAPGQPELWNALLAACRAGDVGVLKLQLAPSPADPRVLSLLSAPLGSGGFTLLHAAAAAGRGSVVRLLLEAGADPTVQDSRARPPYTVAADKSTRNEFRRFMEKNPDAYDYNKAQVPGPLTPEMEARQATRKREQKAARRQREEQQQRQQEQEEREREEQRRFAALSDREKRALAAERRLAAQLGAPTSPIPDSAIVNTRRCWSCGASLQGLTPFHYLDFSFCSTRCLQDHRRQAGRPSS

SEQ ID NO: 5115 - protein, 115 aa, Homo sapiens
  Payload ID: 1106;
  Gene Symbol: ANKZF1;
  Gene Name: ankyrin repeat and zinc finger domain containing 1;
  ENSP ID: ENSP00000394359
MDISEKLFCSTCDQTFQNHQEQREHYKLDWHRFNLKQRLKDKPLLSALDFEKQSSTGDLSSISGSEDSDSASEEDLQTLDRERATFEKLSRPPGFYPHRVLFQNAQGQFLYAYRC

SEQ ID NO: 5116 - protein, 90 aa, Homo sapiens
  Payload ID: 1106;
  Gene Symbol: ANKZF1;
  Gene Name: ankyrin repeat and zinc finger domain containing 1;
  ENSP ID: ENSP00000394652
MSPAPDAAPAPASISLFDLSADAPVFQGLSLVSHAPGEALARAPRTSCSGSGERESPERKLLQGPMDISEKLFCSTCDQTFQNHQEQREH

SEQ ID NO: 5117 - protein, 140 aa, Homo sapiens
  Payload ID: 1106;
  Gene Symbol: ANKZF1;
  Gene Name: ankyrin repeat and zinc finger domain containing 1;
  ENSP ID: ENSP00000399667
MSPAPDAAPAPASISLFDLSADAPVFQGLSLVSHAPGEALARAPRTSCSGSGERESPERKLLQGPMDISEKLFCSTCDQTFQNHQEQREHYKLDWHRFNLKQRLKDKPLLSALDFEKQSSTGDLSSISGSEDSDSASEED

SEQ ID NO: 5118 - protein, 53 aa, Homo sapiens
  Payload ID: 1106;
  Gene Symbol: ANKZF1;
  Gene Name: ankyrin repeat and zinc finger domain containing 1;
  ENSP ID: ENSP00000404113
MSPAPDAAPAPASISLFDLSADAPVFQGLSLVSHAPGEALARAPRTSCSEGTL

SEQ ID NO: 5119 - protein, 59 aa, Homo sapiens
  Payload ID: 1106;
  Gene Symbol: ANKZF1;
  Gene Name: ankyrin repeat and zinc finger domain containing 1;
  ENSP ID: ENSP00000406514
MSPAPDAAPAPASISLFDLSADAPVFQGLSLAQGREKAQKESYSRVLWIFQRSYFVQLV

SEQ ID NO: 5120 - protein, 319 aa, Homo sapiens
  Payload ID: 1107;
  Gene Symbol: ANKRD1;
  Gene Name: ankyrin repeat domain 1 (cardiac muscle);
  Uniprot ID:  Q15327;
  ENSP ID: ENSP00000360762
MMVLKVEELVTGKKNGNGEAGEFLPEDFRDGEYEAAVTLEKQEDLKTLLAHPVTLGEQQWKSEKQREAELKKKKLEQRSKLENLEDLEIIIQLKKRKKYRKTKVPVVKEPEPEIITEPVDVPTFLKAALENKLPVVEKFLSDKNNPDVCDEYKRTALHRACLEGHLAIVEKLMEAGAQIEFRDMLESTAIHWASRGGNLDVLKLLLNKGAKISARDKLLSTALHVAVRTGHYECAEHLIACEADLNAKDREGDTPLHDAVRLNRYKMIRLLIMYGADLNIKNCAGKTPMDLVLHWQNGTKAIFDSLRENSYKTSRIATF

SEQ ID NO: 5121 - protein, 420 aa, Homo sapiens
  Payload ID: 1108;
  Gene Symbol: ANKRD10;
  Gene Name: ankyrin repeat domain 10;
  Uniprot ID:  Q9NXR5;
  ENSP ID: ENSP00000267339
MSAAGAGAGVEAGFSSEELLSLRFPLHRACRDGDLATLCSLLQQTPHAHLASEDSFYGWTPVHWAAHFGKLECLVQLVRAGATLNVSTTRYAQTPAHIAAFGGHPQCLVWLIQAGANINKPDCEGETPIHKAARSGSLECISALVANGAHVDLRNASGLTAADIAQTQGFQECAQFLLNLQNCHLNHFYNNGILNGGHQNVFPNHISVGTNRKRCLEDSEDFGVKKARTEAQSLDSAVPLTNGDTEDDADKMHVDREFAVVTDMKNSSSVSNTLTNGCVINGHLDFPSTTPLSGMESRNGQCLTGTNGISSGLAPGQPFPSSQGSLCISGTEEPEKTLRANPELCGSLHLNGSPSSCIASRPSWVEDIGDNLYYGHYHGFGDTAESIPELNSVVEHSKSVKVQERYDSAVLGTMHLHHGS

SEQ ID NO: 5122 - protein, 220 aa, Homo sapiens
  Payload ID: 1108;
  Gene Symbol: ANKRD10;
  Gene Name: ankyrin repeat domain 10;
  Uniprot ID:  Q9NXR5;
  ENSP ID: ENSP00000312534
MSAAGAGAGVEAGFSSEELLSLRFPLHRACRDGDLATLCSLLQQTPHAHLASEDSFYGWTPVHWAAHFGKLECLVQLVRAGATLNVSTTRYAQTPAHIAAFGGHPQCLVWLIQAGANINKPDCEGETPIHKAARSGSLECISALVANGAHVEFISQSSVHSCLPGELQHGVTFDPSVLIQCLKPEKCQWPDSSRHCTNPGFPRVCPVSLEPPELSSEPFL

SEQ ID NO: 5123 - protein, 161 aa, Homo sapiens
  Payload ID: 1108;
  Gene Symbol: ANKRD10;
  Gene Name: ankyrin repeat domain 10;
  ENSP ID: ENSP00000431927
MSAAGAGAGVEAGFSSEELLSLRFPLHRACRDGDLATLCSLLQQTPHAHLASEDSFYGWTPVHWAAHFGKLECLVQLVRAGATLNVSTTRYAQTPAHIAAFGGHPQCLVWLIQAGANINKPDCEGETPIHKAARSGSLECISALVANGAHVDNPRKGEHSI

SEQ ID NO: 5124 - protein, 121 aa, Homo sapiens
  Payload ID: 1108;
  Gene Symbol: ANKRD10;
  Gene Name: ankyrin repeat domain 10;
  ENSP ID: ENSP00000474638
  MOD_RES (1)..(1): Any amino acid
XGHQNVFPNHISVGTNRKRCLEDSEDFGVKKARTEAQSLDSAVPLTNGDTEDDADKMHVDREFAVVTGGSGQFPVSCNNNPMVEDTKQQESGSVGPKEIEIYTVSAMQTPCRCRNQYAYYF

SEQ ID NO: 5125 - protein, 2663 aa, Homo sapiens
  Payload ID: 1109;
  Gene Symbol: ANKRD11;
  Gene Name: ankyrin repeat domain 11;
  Uniprot ID:  Q6UB99;
  ENSP ID: ENSP00000301030
MPKGGCPKAPQQEELPLSSDMVEKQTGKKDKDKVSLTKTPKLERGDGGKEVRERASKRKLPFTAGANGEQKDSDTEKQGPERKRIKKEPVTRKAGLLFGMGLSGIRAGYPLSERQQVALLMQMTAEESANSPVDTTPKHPSQSTVCQKGTPNSASKTKDKVNKRNERGETRLHRAAIRGDARRIKELISEGADVNVKDFAGWTALHEACNRGYYDVAKQLLAAGAEVNTKGLDDDTPLHDAANNGHYKVVKLLLRYGGNPQQSNRKGETPLKVANSPTMVNLLLGKGTYTSSEESSTESSEEEDAPSFAPSSSVDGNNTDSEFEKGLKHKAKNPEPQKATAPVKDEYEFDEDDEQDRVPPVDDKHLLKKDYRKETKSNSFISIPKMEVKSYTKNNTIAPKKASHRILSDTSDEEDASVTVGTGEKLRLSAHTILPGSKTREPSNAKQQKEKNKVKKKRKKETKGREVRFGKRSDKFCSSESESESSESGEDDRDSLGSSGCLKGSPLVLKDPSLFSSLSASSTSSHGSSAAQKQNPSHTDQHTKHWRTDNWKTISSPAWSEVSSLSDSTRTRLTSESDYSSEGSSVESLKPVRKRQEHRKRASLSEKKSPFLSSAEGAVPKLDKEGKVVKKHKTKHKHKNKEKGQCSISQELKLKSFTYEYEDSKQKSDKAILLENDLSTENKLKVLKHDRDHFKKEEKLSKMKLEEKEWLFKDEKSLKRIKDTNKDISRSFREEKDRSNKAEKERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKDKKRRESAEAGRDRKDALESCKERRDGRAKPEEAHREELKECGCESGFKDKSDGDFGKGLEPWERHHPAREKEKKDGPDKERKEKTKPERYKEKSSDKDKSEKSILEKCQKDKEFDKCFKEKKDTKEKHKDTHGKDKERKASLDQGKEKKEKAFPGIISEDFSEKKDDKKGKEKSWYIADIFTDESEDDRDSCMGSGFKMGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKDKNDSEREPSKKIEKELKPYGSSAINILKEKKKREKHREKWRDEKERHRDRHADGLLRHHRDELLRHHRDEQKPATRDKDSPPRVLKDKSRDEGPRLGDAKLKEKFKDGAEKEKGDPVKMSNGNDKVAPSKDPGKKDARPREKLLGDGDLMMTSFERMLSQKDLEIEERHKRHKERMKQMEKLRHRSGDPKLKEKAKPADDGRKKGLDIPAKKPPGLDPPFKDKKLKESTPIPPAAENKLHPASGADSKDWLAGPHMKEVLPASPRPDQSRPTGVPTPTSVLSCPSYEEVMHTPRTPSCSADDYADLVFDCADSQHSTPVPTAPTSACSPSFFDRFSVASSGLSENASQAPARPLSTNLYRSVSVDIRRTPEEEFSVGDKLFRQQSVPAASSYDSPMPPSMEDRAPLPPVPAEKFACLSPGYYSPDYGLPSPKVDALHCPPAAVVTVTPSPEGVFSSLQAKPSPSPRAELLVPSLEGALPPDLDTSEDQQATAAIIPPEPSYLEPLDEGPFSAVITEEPVEWAHPSEQALASSLIGGTSENPVSWPVGSDLLLKSPQRFPESPKRFCPADPLHSAAPGPFSASEAPYPAPPASPAPYALPVAEPGLEDVKDGVDAVPAAISTSEAAPYAPPSGLESFFSNCKSLPEAPLDVAPEPACVAAVAQVEALGPLENSFLDGSRGLSHLGQVEPVPWADAFAGPEDDLDLGPFSLPELPLQTKDAADGEAEPVEESLAPPEEMPPGAPGVINGGDVSTVVAEEPPALPPDQASTRLPAELEPEPSGEPKLDVALEAAVEAETVPEERARGDPDSSVEPAPVPPEQRPLGSGDQGAEAEGPPAASLCAPDGPAPNTVAQAQAADGAGPEDDTEASRAAAPAEGPPGGIQPEAAEPKPTAEAPKAPRVEEIPQRMTRNRAQMLANQSKQGPPPSEKECAPTPAPVTRAKARGSEDDDAQAQHPRKRRFQRSTQQLQQQLNTSTQQTREVIQQTLAAIVDAIKLDAIEPYHSDRANPYFEYLQIRKKIEEKRKILCCITPQAPQCYAEYVTYTGSYLLDGKPLSKLHIPVIAPPPSLAEPLKELFRQQEAVRGKLRLQHSIEREKLIVSCEQEILRVHCRAARTIANQAVPFSACTMLLDSEVYNMPLESQGDENKSVRDRFNARQFISWLQDVDDKYDRMKTCLLMRQQHEAAALNAVQRMEWQLKVQELDPAGHKSLCVNEVPSFYVPMVDVNDDFVLLPA

SEQ ID NO: 5126 - protein, 97 aa, Homo sapiens
  Payload ID: 1109;
  Gene Symbol: ANKRD11;
  Gene Name: ankyrin repeat domain 11;
  ENSP ID: ENSP00000330815
MPKGGCPKAPQQEELPLSSDMVEKQTGKKDKDKVSLTKTPKLERGDGGKEVRERASKRKLPFTAGANGEQKDSDTDASSPVPVVVLQGWYAPRSTMA

SEQ ID NO: 5127 - protein, 2663 aa, Homo sapiens; identical to SEQ ID NO: 5125
  Payload ID: 1109;
  Gene Symbol: ANKRD11;
  Gene Name: ankyrin repeat domain 11;
  Uniprot ID:  Q6UB99;
  ENSP ID: ENSP00000367581

SEQ ID NO: 5128 - protein, 35 aa, Homo sapiens
  Payload ID: 1109;
  Gene Symbol: ANKRD11;
  Gene Name: ankyrin repeat domain 11;
  ENSP ID: ENSP00000367583
MPKGGCPKAPQQEELPLSSDMVEKQTGKKIFPKES

SEQ ID NO: 5129 - protein, 97 aa, Homo sapiens; identical to SEQ ID NO: 5126
  Payload ID: 1109;
  Gene Symbol: ANKRD11;
  Gene Name: ankyrin repeat domain 11;
  ENSP ID: ENSP00000454550

SEQ ID NO: 5130 - protein, 124 aa, Homo sapiens
  Payload ID: 1109;
  Gene Symbol: ANKRD11;
  Gene Name: ankyrin repeat domain 11;
  ENSP ID: ENSP00000455008
MPKGGCPKAPQQEELPLSSDMVEKQTGKKDKDKVSLTKTPKLERGDGGKEVRERASKRKLPFTAGANGEQKDSDTGPPGSCLSWGSHEGALVRSAMGRSCLPSARGCFFGTRGKIMIFLFCFDL

SEQ ID NO: 5131 - protein, 206 aa, Homo sapiens
  Payload ID: 1109;
  Gene Symbol: ANKRD11;
  Gene Name: ankyrin repeat domain 11;
  ENSP ID: ENSP00000458043
  MOD_RES (1)..(1): Any amino acid
XFPGWTALHEACNRGYYDVAKQLLAAGAEVNTKGLDDDTPLHDAANNGHYKIAPPPSLAEPLKELFRQQEAVRGKLRLQHSIEREKLIVSCEQEILRVHCRAARTIANQAVPFSACTMLLDSEVYNMPLESQGDENKSVRDRFNARQFISWLQDVDDKYDRMKTCLLMRQQHEAAALNAVQRMEWQLKVQELDPAGHKSLCVNEVP

SEQ ID NO: 5132 - protein, 366 aa, Homo sapiens [sequence omitted]

SEQ ID NO: 5133 - protein, 2062 aa, Homo sapiens
  Payload ID: 1110;
  Gene Symbol: ANKRD12;
  Gene Name: ankyrin repeat domain 12;
  Uniprot ID:  Q6UB98;
  ENSP ID: ENSP00000262126
MPKSGFTKPIQSENSDSDSNMVEKPYGRKSKDKIASYSKTPKIERSDVSKEMKEKSSMKRKLPFTISPSRNEERDSDTDSDPGHTSENWGERLISSYRTYSEKEGPEKKKTKKEAGNKKSTPVSILFGYPLSERKQMALLMQMTARDNSPDSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTDSEEAQSVNPSSVDENIDSETEKDSLICESKQILPSKTPLPSALDEYEFKDDDDEEINKMIDDRHILRKEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDCSEKTREEGNFRKSFSPKDDTSLHLFHISTGKSPKHSCGLSEKQSTPLKQEHTKTCLSPGSSEMSLQPDLVRYDNTESEFLPESSSVKSCKHKEKSKHQKDFHLEFGEKSNAKIKDEDHSPTFENSDCTLKKMDKEGKTLKKHKLKHKEREKEKHKKEIEGEKEKYKTKDSAKELQRSVEFDREFWKENFFKSDETEDLFLNMEHESLTLEKKSKLEKNIKDDKSTKEKHVSKERNFKEERDKIKKESEKSFREEKIKDLKEERENIPTDKDSEFTSLGMSAIEESIGLHLVEKEIDIEKQEKHIKESKEKPEKRSQIKEKDIEKMERKTFEKEKKIKHEHKSEKDKLDLSECVDKIKEKDKLYSHHTEKCHKEGEKSKNTAAIKKTDDREKSREKMDRKHDKEKPEKERHLAESKEKHLMEKKNKQSDNSEYSKSEKGKNKEKDRELDKKEKSRDKESINITNSKHIQEEKKSSIVDGNKAQHEKPLSLKEKTKDEPLKTPDGKEKDKKDKDIDRYKERDKHKDKIQINSLLKLKSEADKPKPKSSPASKDTRPKEKRLVNDDLMQTSFERMLSLKDLEIEQWHKKHKEKIKQKEKERLRNRNCLELKIKDKEKTKHTPTESKNKELTRSKSSEVTDAYTKEKQPKDAVSNRSQSVDTKNVMTLGKSSFVSDNSLNRSPRSENEKPGLSSRSVSMISVASSEDSCHTTVTTPRPPVEYDSDFMLESSESQMSFSQSPFLSIAKSPALHERELDSLADLPERIKPPYANRLSTSHLRSSSVEDVKLIISEGRPTIEVRRCSMPSVICEHTKQFQTISEESNQGSLLTVPGDTSPSPKPEVFSNVPERDLSNVSNIHSSFATSPTGASNSKYVSADRNLIKNTAPVNTVMDSPVHLEPSSQVGVIQNKSWEMPVDRLETLSTRDFICPNSNIPDQESSLQSFCNSENKVLKENADFLSLRQTELPGNSCAQDPASFMPPQQPCSFPSQSLSDAESISKHMSLSYVANQEPGILQQKNAVQIISSALDTDNESTKDTENTFVLGDVQKTDAFVPVYSDSTIQEASPNFEKAYTLPVLPSEKDFNGSDASTQLNTHYAFSKLTYKSSSGHEVENSTTDTQVISHEKENKLESLVLTHLSRCDSDLCEMNAGMPKGNLNEQDPKHCPESEKCLLSIEDEESQQSILSSLENHSQQSTQPEMHKYGQLVKVELEENAEDDKTENQIPQRMTRNKANTMANQSKQILASCTLLSEKDSESSSPRGRIRLTEDDDPQIHHPRKRKVSRVPQPVQVSPSLLQAKEKTQQSLAAIVDSLKLDEIQPYSSERANPYFEYLHIRKKIEEKRKLLCSVIPQAPQYYDEYVTFNGSYLLDGNPLSKICIPTITPPPSLSDPLKELFRQQEVVRMKLRLQHSIEREKLIVSNEQEVLRVHYRAARTLANQTLPFSACTVLLDAEVYNVPLDSQSDDSKTSVRDRFNARQFMSWLQDVDDKFDKLKTCLLMRQQHEAAALNAVQRLEWQLKLQELDPATYKSISIYEIQEFYVPLVDVNDDFELTPI

SEQ ID NO: 5134 - protein, 97 aa, Homo sapiens
  Payload ID: 1110;
  Gene Symbol: ANKRD12;
  Gene Name: ankyrin repeat domain 12;
  ENSP ID: ENSP00000352073
  MOD_RES (1)..(1): Any amino acid
XCNVGYYDVAKILIAAGADVNTQGLDDDTPLHDSASSGHRDIVKLLLRHGGNPFQANKHGERPVDVAETEELELLLKREVPLSDDDESYTEYLFSTW

SEQ ID NO: 5135 - protein, 438 aa, Homo sapiens
  Payload ID: 1110;
  Gene Symbol: ANKRD12;
  Gene Name: ankyrin repeat domain 12;
  ENSP ID: ENSP00000372932
MVNVPELLLGQSPSRNDTKIINSEEAQSVNPSSVDENIDSETEKDSLICESKQILPSKTPLPSALDEYEFKDDDDEEINKMIDDRHILRKEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDCSEKTREEGNFRKSFSPKDDTSLHLFHISTGKSPKHSCGLSEKQSTPLKQEHTKTCLSPGSSEMSLQPDLVRYDNTESEFLPESSSVKSCKHKEKSKHQKDFHLEFGEKSNAKIKDEDHSPTFENSDCTLKKMDKEGKTLKKHKLKHKEREKEKHKKEIEGEKEKYKTKDSAKELQRSVEFDREFWKENFFKSDETEDLFLNMEHESLTLEKIKIGKKHQR

SEQ ID NO: 5136 - protein, 2039 aa, Homo sapiens
  Payload ID: 1110;
  Gene Symbol: ANKRD12;
  Gene Name: ankyrin repeat domain 12;
  Uniprot ID:  Q6UB98;
  ENSP ID: ENSP00000382897
MPKSGFTKPIQSENSDSDSNMVEKPYGRKSKDKIASYSKTPKIERSDVSKEMKEKSSMKRKLPFTISPSRNEERDSDTEKEGPEKKKTKKEAGNKKSTPVSILFGYPLSERKQMALLMQMTARDNSPDSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTDSEEAQSVNPSSVDENIDSETEKDSLICESKQILPSKTPLPSALDEYEFKDDDDEEINKMIDDRHILRKEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDCSEKTREEGNFRKSFSPKDDTSLHLFHISTGKSPKHSCGLSEKQSTPLKQEHTKTCLSPGSSEMSLQPDLVRYDNTESEFLPESSSVKSCKHKEKSKHQKDFHLEFGEKSNAKIKDEDHSPTFENSDCTLKKMDKEGKTLKKHKLKHKEREKEKHKKEIEGEKEKYKTKDSAKELQRSVEFDREFWKENFFKSDETEDLFLNMEHESLTLEKKSKLEKNIKDDKSTKEKHVSKERNFKEERDKIKKESEKSFREEKIKDLKEERENIPTDKDSEFTSLGMSAIEESIGLHLVEKEIDIEKQEKHIKESKEKPEKRSQIKEKDIEKMERKTFEKEKKIKHEHKSEKDKLDLSECVDKIKEKDKLYSHHTEKCHKEGEKSKNTAAIKKTDDREKSREKMDRKHDKEKPEKERHLAESKEKHLMEKKNKQSDNSEYSKSEKGKNKEKDRELDKKEKSRDKESINITNSKHIQEEKKSSIVDGNKAQHEKPLSLKEKTKDEPLKTPDGKEKDKKDKDIDRYKERDKHKDKIQINSLLKLKSEADKPKPKSSPASKDTRPKEKRLVNDDLMQTSFERMLSLKDLEIEQWHKKHKEKIKQKEKERLRNRNCLELKIKDKEKTKHTPTESKNKELTRSKSSEVTDAYTKEKQPKDAVSNRSQSVDTKNVMTLGKSSFVSDNSLNRSPRSENEKPGLSSRSVSMISVASSEDSCHTTVTTPRPPVEYDSDFMLESSESQMSFSQSPFLSIAKSPALHERELDSLADLPERIKPPYANRLSTSHLRSSSVEDVKLIISEGRPTIEVRRCSMPSVICEHTKQFQTISEESNQGSLLTVPGDTSPSPKPEVFSNVPERDLSNVSNIHSSFATSPTGASNSKYVSADRNLIKNTAPVNTVMDSPVHLEPSSQVGVIQNKSWEMPVDRLETLSTRDFICPNSNIPDQESSLQSFCNSENKVLKENADFLSLRQTELPGNSCAQDPASFMPPQQPCSFPSQSLSDAESISKHMSLSYVANQEPGILQQKNAVQIISSALDTDNESTKDTENTFVLGDVQKTDAFVPVYSDSTIQEASPNFEKAYTLPVLPSEKDFNGSDASTQLNTHYAFSKLTYKSSSGHEVENSTTDTQVISHEKENKLESLVLTHLSRCDSDLCEMNAGMPKGNLNEQDPKHCPESEKCLLSIEDEESQQSILSSLENHSQQSTQPEMHKYGQLVKVELEENAEDDKTENQIPQRMTRNKANTMANQSKQILASCTLLSEKDSESSSPRGRIRLTEDDDPQIHHPRKRKVSRVPQPVQVSPSLLQAKEKTQQSLAAIVDSLKLDEIQPYSSERANPYFEYLHIRKKIEEKRKLLCSVIPQAPQYYDEYVTFNGSYLLDGNPLSKICIPTITPPPSLSDPLKELFRQQEVVRMKLRLQHSIEREKLIVSNEQEVLRVHYRAARTLANQTLPFSACTVLLDAEVYNVPLDSQSDDSKTSVRDRFNARQFMSWLQDVDDKFDKLKTCLLMRQQHEAAALNAVQRLEWQLKLQELDPATYKSISIYEIQEFYVPLVDVNDDFELTPI

SEQ ID NO: 5137 - protein, 310 aa, Homo sapiens
  Payload ID: 1110;
  Gene Symbol: ANKRD12;
  Gene Name: ankyrin repeat domain 12;
  ENSP ID: ENSP00000441510
MPKSGFTKPIQSENSDSDSNMVEKPYGRKSKDKIASYSKTPKIERSDVSKEMKEKSSMKRKLPFTISPSRNEERDSDTEKEGPEKKKTKKEAGNKKSTPVSILFGYPLSERKQMALLMQMTARDNNSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTDSEEAQSVNPSSVDENIDSET

SEQ ID NO: 5138 - protein, 12 aa, Homo sapiens
  Payload ID: 1110;
  Gene Symbol: ANKRD12;
  Gene Name: ankyrin repeat domain 12;
  ENSP ID: ENSP00000462312
MPKSGFTKPIQS

SEQ ID NO: 5139 - protein, 82 aa, Homo sapiens
  Payload ID: 1110;
  Gene Symbol: ANKRD12;
  Gene Name: ankyrin repeat domain 12;
  ENSP ID: ENSP00000462659
MPKSGFTKPIQSENSDSDSNMVEKPYGRKSKDKIASYSKTPKIERSDVSKEMKEKSSMKRKLPFTISPSRNEERDSDTELTG

SEQ ID NO: 5140 - protein, 44 aa, Homo sapiens
  Payload ID: 1110;
  Gene Symbol: ANKRD12;
  Gene Name: ankyrin repeat domain 12;
  ENSP ID: ENSP00000464422
MPKSGFTKPIQSENSDSDSNMVEKPYGRKSKDKIASYSKTPKIE

SEQ ID NO: 5141 - protein, 518 aa, Homo sapiens
  Payload ID: 1111;
  Gene Symbol: ANKRD13D;
  Gene Name: ankyrin repeat domain 13 family, member D;
  Uniprot ID:  Q6ZTN6;
  ENSP ID: ENSP00000310874
MVQLVLQYRDYQRATQRLAGIPELLNKLRQAPDFYVEMKWEFTSWVPLVSKMCPSDVYRVWKRGESLRVDTSLLGFEHMTWQRGRRSFIFKGQEAGALVMEVDHDRQVVHVETLGLTLQEPETLLAAMRPSEEHVASRLTSPIVSTHLDTRNVAFERNKCGIWGWRSEKMETVSGYEAKVYSATNVELVTRTRTEHLSDQDKSRSKAGKTPFQSFLGMAQQHSSHTGAPVQQAASPTNPTAISPEEYFDPNFSLESRNIGRPIEMSSKVQRFKATLWLSEEHPLSLGDQVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEDDDLLQFAIQQSLLEAGTEAEQVTVWEALTNTRPGARPPPQATVYEEQLQLERALQESLQLSTEPRGPGSPPRTPPAPGPPSFEEQLRLALELSSREQEERERRGQQEEEDLQRILQLSLTEH

SEQ ID NO: 5142 - protein, 518 aa, Homo sapiens; identical to SEQ ID NO: 5141
  Payload ID: 1111;
  Gene Symbol: ANKRD13D;
  Gene Name: ankyrin repeat domain 13 family, member D;
  Uniprot ID:  Q6ZTN6;
  ENSP ID: ENSP00000402616

SEQ ID NO: 5143 - protein, 605 aa, Homo sapiens
  Payload ID: 1111;
  Gene Symbol: ANKRD13D;
  Gene Name: ankyrin repeat domain 13 family, member D;
  Uniprot ID:  Q6ZTN6;
  ENSP ID: ENSP00000427130
MAGPGPTFPLHRLVWANRHRELEAALHSHQHDIEQEDPRGRTPLELAVSLGNLESVRVLLRHNANVGKENRQGWAVLQEAVSTGDPEMVQLVLQYRDYQRATQRLAGIPELLNKLRQAPDFYVEMKWEFTSWVPLVSKMCPSDVYRVWKRGESLRVDTSLLGFEHMTWQRGRRSFIFKGQEAGALVMEVDHDRQVVHVETLGLTLQEPETLLAAMRPSEEHVASRLTSPIVSTHLDTRNVAFERNKCGIWGWRSEKMETVSGYEAKVYSATNVELVTRTRTEHLSDQDKSRSKAGKTPFQSFLGMAQQHSSHTGAPVQQAASPTNPTAISPEEYFDPNFSLESRNIGRPIEMSSKVQRFKATLWLSEEHPLSLGDQVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEDDDLLQFAIQQSLLEAGTEAEQVTVWEALTNTRPGARPPPQATVYEEQLQLERALQESLQLSTEPRGPGSPPRTPPAPGPPSFEEQLRLALELSSREQEERERRGQQEEEDLQRILQLSLTEH

SEQ ID NO: 5144 - protein, 255 aa, Homo sapiens
  Payload ID: 1111;
  Gene Symbol: ANKRD13D;
  Gene Name: ankyrin repeat domain 13 family, member D;
  Uniprot ID:  Q6ZTN6;
  ENSP ID: ENSP00000443977
MSCGRLGRFKATLWLSEEHPLSLGDQVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEDDDLLQFAIQQSLLEAGTEAEQVTVWEALTNTRPGARPPPQATVYEEQLQLERALQESLQLSTEPRGPGSPPRTPPAPGPPSFEEQLRLALELSSREQEERERRGQQEEEDLQRILQLSLTEH

SEQ ID NO: 5145 - protein, 518 aa, Homo sapiens; identical to SEQ ID NO: 5141
  Payload ID: 1111;
  Gene Symbol: ANKRD13D;
  Gene Name: ankyrin repeat domain 13 family, member D;
  Uniprot ID:  Q6ZTN6;
  ENSP ID: ENSP00000444404

SEQ ID NO: 5146 - protein, 32 aa, Homo sapiens
  Payload ID: 1111;
  Gene Symbol: ANKRD13D;
  Gene Name: ankyrin repeat domain 13 family, member D;
  ENSP ID: ENSP00000480227
  MOD_RES (1)..(1): Any amino acid
XAISPEEYFDPNFSLESRNIGRPIEMSSKVQR

SEQ ID NO: 5147 - protein, 109 aa, Homo sapiens
  Payload ID: 1111;
  Gene Symbol: ANKRD13D;
  Gene Name: ankyrin repeat domain 13 family, member D;
  ENSP ID: ENSP00000482134
MVQLVLQYRDYQRATQRLAGIPELLNKLRQAPDFYVEMKWEFTSWVPLVSKMCPSDVYRVWKRGESLRVDTSLLGFEHMTWQRGRRSFIFKGQEAGALVMEVDHDRQVV

SEQ ID NO: 5148 - protein, 590 aa, Homo sapiens
  Payload ID: 1112;
  Gene Symbol: ANKRD13A;
  Gene Name: ankyrin repeat domain 13A;
  Uniprot ID:  Q8IZ07;
  ENSP ID: ENSP00000261739
MSSACDAGDHYPLHLLVWKNDYRQLEKELQGQNVEAVDPRGRTLLHLAVSLGHLESARVLLRHKADVTKENRQGWTVLHEAVSTGDPEMVYTVLQHRDYHNTSMALEGVPELLQKILEAPDFYVQMKWEFTSWVPLVSRICPNDVCRIWKSGAKLRVDITLLGFENMSWIRGRRSFIFKGEDNWAELMEVNHDDKVVTTERFDLSQEMERLTLDLMKPKSREVERRLTSPVINTSLDTKNIAFERTKSGFWGWRTDKAEVVNGYEAKVYTVNNVNVITKIRTEHLTEEEKKRYKADRNPLESLLGTVEHQFGAQGDLTTECATANNPTAITPDEYFNEEFDLKDRDIGRPKELTIRTQKFKAMLWMCEEFPLSLVEQVIPIIDLMARTSAHFARLRDFIKLEFPPGFPVKIEIPLFHVLNARITFGNVNGCSTAEESVSQNVEGTQADSASHITNFEVDQSVFEIPESYYVQDNGRNVHLQDEDYEIMQFAIQQSLLESSRSQELSGPASNGGISQTNTYDAQYERAIQESLLTSTEGLCPSALSETSRFDNDLQLAMELSAKELEEWELRLQEEEAELQQVLQLSLTDK

SEQ ID NO: 5149 - protein, 83 aa, Homo sapiens
  Payload ID: 1112;
  Gene Symbol: ANKRD13A;
  Gene Name: ankyrin repeat domain 13A;
  ENSP ID: ENSP00000447110
LMARTSAHFARLRDFIKLEFPPGFPVKIEIPLFHVLNARITFGNVNGCSTAEESVSQNVEGTQADSGTFRTSFEWRDQPDKHL

SEQ ID NO: 5150 - protein, 301 aa, Homo sapiens
  Payload ID: 1112;
  Gene Symbol: ANKRD13A;
  Gene Name: ankyrin repeat domain 13A;
  ENSP ID: ENSP00000449781
  MOD_RES (1)..(1): Any amino acid
XIWKSGAKLRVDITLLGFENMSWIRGRRSFIFKGEDNWAELMEVNHDDKVVTTERFDLSQEMERLTLDLMKPKSREVERRLTSPVINTSLDTKNIAFERTKSGFWGWRTDKAEVVNGYEAKVYTVNNVNVITKIRTEHLTEEEKKRYKDRNPLESLLGTVEHQFGAQGDLTTECATANNPTAITPDEYFNEEFDLKDRDIGRPKELTIRTQKFKAMLWMCEEFPLSLVEQVIPIIDLMARTSAHFARLRDFIKLEFPPGFPVKIEIPLFHVLNARITFGNVNGCSTAEESVSQNVEGTQAD

SEQ ID NO: 5151 - protein, 173 aa, Homo sapiens
  Payload ID: 1112;
  Gene Symbol: ANKRD13A;
  Gene Name: ankyrin repeat domain 13A;
  ENSP ID: ENSP00000474172
MVYTVLQHRDYHNTSMALEGVPELLQKILEAPDFYVQMKWEFTSWVPLVSRICPNDVCRIWKSGAKLRVDITLLGFENMSWIRGRRSFIFKGEDNWAELMEVNHDDKVVTTERFDLSQEMERLTLDLMKPKSREVERRLTSPVINTSLDTKNIAFERVFRVLKLTLLQLTVCS

SEQ ID NO: 5152 - protein, 173 aa, Homo sapiens
  Payload ID: 1112;
  Gene Symbol: ANKRD13A;
  Gene Name: ankyrin repeat domain 13A;
  ENSP ID: ENSP00000474745
  MOD_RES (1)..(1): Any amino acid
XPDEYFNEEFDLKDRDIGRPKELTIRTQKFKAMLWMCEEFPLSLVEQVIPIIDLMARTSAHFARLRDFIKLEFPPGFPVKIEIPLFHVLNARITFGNVNGCSTAEESVSQNVEGTQADSASHITNFEVDQSVFEIPESYYVQDNGRNVHLQDEDYEIMQFAIQQILQLSLTDK

SEQ ID NO: 5153 - protein, 626 aa, Homo sapiens
  Payload ID: 1113;
  Gene Symbol: ANKRD13B;
  Gene Name: ankyrin repeat domain 13B;
  Uniprot ID:  Q86YJ7;
  ENSP ID: ENSP00000378328
MIPANASARKGPEGKYPLHYLVWHNRHRELEKEVRAGQVDIEQLDPRGRTPLHLATTLGHLECARVLLAHGADVGRENRSGWTVLQEAVSTRDLELVQLVLRYRDYQRVVKRLAGIPVLLEKLRKAQDFYVEMKWEFTSWVPLVSKICPSDTYKVWKSGQNLRVDTTLLGFDHMTWQRGNRSFVFRGQDTSAVVMEIDHDRRVVYTETLALAGQDRELLLAAAQPTEEQVLSRLTAPVVTTQLDTKNISFERNKTGILGWRSEKTEMVNGYEAKVYGASNVELITRTRTEHLSEQHKGKVKGCKTPLQSFLGIAEQHGGPQNGTLITQTLSQANPTAITAEEYFNPNFELGNRDMGRPMELTTKTQKFKAKLWLCEEHPLSLCEQVAPIIDLMAVSNALFAKLRDFITLRLPPGFPVKIEIPIFHILNARITFGNLNGCDEPVPSVRGSPSSETPSPGSDSSSVSSSSSTTSCRGCEISPALFEAPRGYSMMGGQREAATRDDDDDLLQFAIQQSLLEAGSEYDQVTIWEALTNSKPGTHPMSYEGRRQDRSAPPTPQRQPAPPASVPSPRPSSGPGSGGHVFRSYDEQLRLAMELSAQEQEERRRRARQEEEELERILRLSLTEQ

SEQ ID NO: 5154 - protein, 626 aa, Homo sapiens; identical to SEQ ID NO: 5153
  Payload ID: 1113;
  Gene Symbol: ANKRD13B;
  Gene Name: ankyrin repeat domain 13B;
  Uniprot ID:  Q86YJ7;
  ENSP ID: ENSP00000431958

SEQ ID NO: 5155 - protein, 128 aa, Homo sapiens
  Payload ID: 1113;
  Gene Symbol: ANKRD13B;
  Gene Name: ankyrin repeat domain 13B;
  ENSP ID: ENSP00000465708
EPVPSVRGSPSSETPSPGSDSSSVSSSSSTTSCRGCEISPALFEAPRGYSMMGGQREAATRDDDDDLLQFAIQQSLLEAGSEYDQVTIWEALTNSKPGTHPMSYEGRRQDRSVPAGPERILRRGSCLP

SEQ ID NO: 5156 - protein, 68 aa, Homo sapiens
  Payload ID: 1113;
  Gene Symbol: ANKRD13B;
  Gene Name: ankyrin repeat domain 13B;
  ENSP ID: ENSP00000467078
MKWEFTSWVPLVSKICPSDTYKVWKSGQNLRVDTTLLGFDHMTWQRGNRSFVFRGQDTSAVVMEIDHD

SEQ ID NO: 5157 - protein, 626 aa, Homo sapiens; identical to SEQ ID NO: 5153
  Payload ID: 1113;
  Gene Symbol: ANKRD13B;
  Gene Name: ankyrin repeat domain 13B;
  Uniprot ID:  Q86YJ7;
  ENSP ID: ENSP00000481530

SEQ ID NO: 5158 - protein, 506 aa, Homo sapiens
  Payload ID: 1114;
  Gene Symbol: ANKRD13C;
  Gene Name: ankyrin repeat domain 13C;
  Uniprot ID:  Q8N6S4;
  ENSP ID: ENSP00000262346
MTGEKIRSLRRDHKPSKEEGDLLEPGDEEAAAALGGTFTRSRIGKGGKACHKIFSNHHHRLQLKAAPASSNPPGAPALPLHNSSVTANSQSPALLAGTNPVAVVADGGSCPAHYPVHECVFKGDVRRLSSLIRTHNIGQKDNHGNTPLHLAVMLGNKVTALLRKLKQQSRESVEEKRPRLLKALKELGDFYLELHWDFQSWVPLLSRILPSDACKIYKQGINIRLDTTLIDFTDMKCQRGDLSFIFNGDAAPSESFVVLDNEQKVYQRIHHEESEMETEEEVDILMSSDIYSATLSTKSISFTRAQTGWLFREDKTERVGNFLADFYLVNGLVLESRKRREHLSEEDILRNKAIMESLSKGGNIMEQNFEPIRRQSLTPPPQNTITWEEYISAENGKAPHLGRELVCKESKKTFKATIAMSQEFPLGIELLLNVLEVVAPFKHFNKLREFVQMKLPPGFPVKLDIPVFPTITATVTFQEFRYDEFDGSIFTIPDDYKEDPSRFPDL

SEQ ID NO: 5159 - protein, 541 aa, Homo sapiens
  Payload ID: 1114;
  Gene Symbol: ANKRD13C;
  Gene Name: ankyrin repeat domain 13C;
  Uniprot ID:  Q8N6S4;
  ENSP ID: ENSP00000359982
MTGEKIRSLRRDHKPSKEEGDLLEPGDEEAAAALGGTFTRSRIGKGGKACHKIFSNHHHRLQLKAAPASSNPPGAPALPLHNSSVTANSQSPALLAGTNPVAVVADGGSCPAHYPVHECVFKGDVRRLSSLIRTHNIGQKDNHGNTPLHLAVMLGNKECAHLLLAHNAPVKVKNAQGWSPLAEAISYGDRQMITALLRKLKQQSRESVEEKRPRLLKALKELGDFYLELHWDFQSWVPLLSRILPSDACKIYKQGINIRLDTTLIDFTDMKCQRGDLSFIFNGDAAPSESFVVLDNEQKVYQRIHHEESEMETEEEVDILMSSDIYSATLSTKSISFTRAQTGWLFREDKTERVGNFLADFYLVNGLVLESRKRREHLSEEDILRNKAIMESLSKGGNIMEQNFEPIRRQSLTPPPQNTITWEEYISAENGKAPHLGRELVCKESKKTFKATIAMSQEFPLGIELLLNVLEVVAPFKHFNKLREFVQMKLPPGFPVKLDIPVFPTITATVTFQEFRYDEFDGSIFTIPDDYKEDPSRFPDL

SEQ ID NO: 5160 - protein, 304 aa, Homo sapiens
  Payload ID: 1115;
  Gene Symbol: ANKRD16;
  Gene Name: ankyrin repeat domain 16;
  Uniprot ID:  Q6P6B7;
  ENSP ID: ENSP00000352361
MAQPGDPRRLCRLVQEGRLRALKEELQAAGGCPGPAGDTLLHCAARHGHRDVLAYLAEAWGMDIEATNRDYKRPLHEAASMGHRDCVRYLLGRGAAVDCLKKADWTPLMMACTRKNLGVIQELVEHGANPLLKNKDGWNSFHIASREGDPLILQYLLTVCPGAWKTESKIRRTPLHTAAMHGHLEAVKVLLKRCQYEPDYRDNCGVTALMDAIQCGHIDVARLLLDEHGACLSAEDSLGAQALHRAAVTGQDEAIRFLVSELGVDVDVRATSTHLTALHYAAKPCIWPVQVSTWPVPSFSCSRD

SEQ ID NO: 5161 - protein, 361 aa, Homo sapiens
  Payload ID: 1115;
  Gene Symbol: ANKRD16;
  Gene Name: ankyrin repeat domain 16;
  Uniprot ID:  Q6P6B7;
  ENSP ID: ENSP00000369434
MAQPGDPRRLCRLVQEGRLRALKEELQAAGGCPGPAGDTLLHCAARHGHRDVLAYLAEAWGMDIEATNRDYKRPLHEAASMGHRDCVRYLLGRGAAVDCLKKADWTPLMMACTRKNLGVIQELVEHGANPLLKNKDGWNSFHIASREGDPLILQYLLTVCPGAWKTESKIRRTPLHTAAMHGHLEAVKVLLKRCQYEPDYRDNCGVTALMDAIQCGHIDVARLLLDEHGACLSAEDSLGAQALHRAAVTGQDEAIRFLVSELGVDVDVRATSTHLTALHYAAKEGHTSTIQTLLSLGADINSKDEKNRSALHLACAGQHLACAKFLLQSGLKDSEDITGTLAQQLPRRADVLQGSGHSAMT

SEQ ID NO: 5162 - protein, 361 aa, Homo sapiens; identical to SEQ ID NO: 5161
  Payload ID: 1115;
  Gene Symbol: ANKRD16;
  Gene Name: ankyrin repeat domain 16;
  Uniprot ID:  Q6P6B7;
  ENSP ID: ENSP00000369436

SEQ ID NO: 5163 - protein, 2352 aa, Homo sapiens
  Payload ID: 1116;
  Gene Symbol: ANKRD17;
  Gene Name: ankyrin repeat domain 17;
  Uniprot ID:  O75179;
  ENSP ID: ENSP00000332265
MEKATVPVAAATAAEGEGSPPAVAAVAGPPAAAEVGGGVGGSSRARSASSPRGMVRVCDLLLKKKPPQQQHHKAKRNRTCRPPSSSESSSDSDNSGGGGGGGGGGGGGGGTSSNNSEEEEDDDDEEEEVSEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKLKVEDEPEVLTEPPSATTTTTIGISATWTTLAGSHGKRNNTITTTSSKRKNRKNKITPENVQIIFDDPLPISYSQPEKVNGESKSSSTSESGDSDNMRISSCSDESSNSNSSRKSDNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNRLKSSSANSKIGSSAPTTTAANTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTTTTSSSASTVPGTSTNGSPSSPSVRRQLFVTVVKTSNATTTTVTTTASNNNTAPTNATYPMPTAKEHYPVSSPSSPSPPAQPGGVSRNSPLDCGSASPNKVASSSEQEAGSPPVVETTNTRPPNSSSSSGSSSAHSNQQQPPGSVSQEPRPPLQQSQVPPPEVRMTVPPLATSSAPVAVPSTAPVTYPMPQTPMGCPQPTPKMETPAIRPPPHGTTAPHKNSASVQNSSVAVLSVNHIKRPHSVPSSVQLPSTLSTQSACQNSVHPANKPIAPNFSAPLPFGPFSTLFENSPTSAHAFWGGSVVSSQSTPESMLSGKSSYLPNSDPLHQSDTSKAPGFRPPLQRPAPSPSGIVNMDSPYGSVTPSSTHLGNFASNISGGQMYGPGAPLGGAPAAANFNRQHFSPLSLLTPCSSASNDSSAQSVSSGVRAPSPAPSSVPLGSEKPSNVSQDRKVPVPIGTERSARIRQTGTSAPSVIGSNLSTSVGHSGIWSFEGIGGNQDKVDWCNPGMGNPMIHRPMSDPGVFSQHQAMERDSTGIVTPSGTFHQHVPAGYMDFPKVGGMPFSVYGNAMIPPVAPIPDGAGGPIFNGPHAADPSWNSLIKMVSSSTENNGPQTVWTGPWAPHMNSVHMNQLG

SEQ ID NO: 5164 - protein, 2603 aa, Homo sapiens
  Payload ID: 1116;
  Gene Symbol: ANKRD17;
  Gene Name: ankyrin repeat domain 17;
  Uniprot ID:  O75179;
  ENSP ID: ENSP00000351416
MEKATVPVAAATAAEGEGSPPAVAAVAGPPAAAEVGGGVGGSSRARSASSPRGMVRVCDLLLKKKPPQQQHHKAKRNRTCRPPSSSESSSDSDNSGGGGGGGGGGGGGGGTSSNNSEEEEDDDDEEEEVSEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAASKQKSSSHLPANSQDVQGYITNQSPESIVEEAQGKLTELEQRIKEAIEKNAQLQSLELAHADQLTKEKIEELNKTREEQIQKKQKILEELQKVERELQLKTQQQLKKQYLEVKAQRIQLQQQQQQSCQHLGLLTPVGVGEQLSEGDYARLQQVDPVLLKDEPQQTAAQMGFAPIQPLAMPQALPLAAGPLPPGSIANLTELQGVIVGQPVLGQAQLAGLGQGILTETQQGLMVASPAQTLNDTLDDIMAAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKLKVEDEPEVLTEPPSATTTTTIGISATWTTLAGSHGKRNNTITTTSSKRKNRKNKITPENVQIIFDDPLPISYSQPEKVNGESKSSSTSESGDSDNMRISSCSDESSNSNSSRKSDNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNRLKSSSANSKIGSSAPTTTAANTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTTTTSSSASTVPGTSTNGSPSSPSVRRQLFVTVVKTSNATTTTVTTTASNNNTAPTNATYPMPTAKEHYPVSSPSSPSPPAQPGGVSRNSPLDCGSASPNKVASSSEQEAGSPPVVETTNTRPPNSSSSSGSSSAHSNQQQPPGSVSQEPRPPLQQSQVPPPEVRMTVPPLATSSAPVAVPSTAPVTYPMPQTPMGCPQPTPKMETPAIRPPPHGTTAPHKNSASVQNSSVAVLSVNHIKRPHSVPSSVQLPSTLSTQSACQNSVHPANKPIAPNFSAPLPFGPFSTLFENSPTSAHAFWGGSVVSSQSTPESMLSGKSSYLPNSDPLHQSDTSKAPGFRPPLQRPAPSPSGIVNMDSPYGSVTPSSTHLGNFASNISGGQMYGPGAPLGGAPAAANFNRQHFSPLSLLTPCSSASNDSSAQSVSSGVRAPSPAPSSVPLGSEKPSNVSQDRKVPVPIGTERSARIRQTGTSAPSVIGSNLSTSVGHSGIWSFEGIGGNQDKVDWCNPGMGNPMIHRPMSDPGVFSQHQAMERDSTGIVTPSGTFHQHVPAGYMDFPKVGGMPFSVYGNAMIPPVAPIPDGAGGPIFNGPHAADPSWNSLIKMVSSSTENNGPQTVWTGPWAPHMNSVHMNQLG

SEQ ID NO: 5165 - protein, 2490 aa, Homo sapiens
  Payload ID: 1116;
  Gene Symbol: ANKRD17;
  Gene Name: ankyrin repeat domain 17;
  Uniprot ID:  O75179;
  ENSP ID: ENSP00000427151
MVETAAEMEAYVLEDILEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAASKQKSSSHLPANSQDVQGYITNQSPESIVEEAQGKLTELEQRIKEAIEKNAQLQSLELAHADQLTKEKIEELNKTREEQIQKKQKILEELQKVERELQLKTQQQLKKQYLEVKAQRIQLQQQQQQSCQHLGLLTPVGVGEQLSEGDYARLQQVDPVLLKDEPQQTAAQMGFAPIQPLAMPQALPLAAGPLPPGSIANLTELQGVIVGQPVLGQAQLAGLGQGILTETQQGLMVASPAQTLNDTLDDIMAAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKLKVEDEPEVLTEPPSATTTTTIGISATWTTLAGSHGKRNNTITTTSSKRKNRKNKITPENVQIIFDDPLPISYSQPEKVNGESKSSSTSESGDSDNMRISSCSDESSNSNSSRKSDNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNRLKSSSANSKIGSSAPTTTAANTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTTTTSSSASTVPGTSTNGSPSSPSVRRQLFVTVVKTSNATTTTVTTTASNNNTAPTNATYPMPTAKEHYPVSSPSSPSPPAQPGGVSRNSPLDCGSASPNKVASSSEQEAGSPPVVETTNTRPPNSSSSSGSSSAHSNQQQPPGSVSQEPRPPLQQSQVPPPEVRMTVPPLATSSAPVAVPSTAPVTYPMPQTPMGCPQPTPKMETPAIRPPPHGTTAPHKNSASVQNSSVAVLSVNHIKRPHSVPSSVQLPSTLSTQSACQNSVHPANKPIAPNFSAPLPFGPFSTLFENSPTSAHAFWGGSVVSSQSTPESMLSGKSSYLPNSDPLHQSDTSKAPGFRPPLQRPAPSPSGIVNMDSPYGSVTPSSTHLGNFASNISGGQMYGPGAPLGGAPAAANFNRQHFSPLSLLTPCSSASNDSSAQSVSSGVRAPSPAPSSVPLGSEKPSNVSQDRKVPVPIGTERSARIRQTGTSAPSVIGSNLSTSVGHSGIWSFEGIGGNQDKVDWCNPGMGNPMIHRPMSDPGVFSQHQAMERDSTGIVTPSGTFHQHVPAGYMDFPKVGGMPFSVYGNAMIPPVAPIPDGAGGPIFNGPHAADPSWNSLIKMVSSSTENNGPQTVWTGPWAPHMNSVHMNQLG

SEQ ID NO: 5166 - protein, 862 aa, Homo sapiens
  Payload ID: 1116;
  Gene Symbol: ANKRD17;
  Gene Name: ankyrin repeat domain 17;
  ENSP ID: ENSP00000453294
MEKATVPVAAATAAEGEGSPPAVAAVAGPPAAAEVGGGVGGSSRARSASSPRGMVRVCDLLLKKKPPQQQHHKAKRNRTCRPPSSSESSSDSDNSGGGGGGGGGGGGGGGTSSNNSEEEEDDDDEEEEPDKPPANVATTLPIRNKAASKQKSSSHLPANSQDVQGYITNQSPESIVEEAQGKLTELEQRIKEAIEKNAQLQSLELAHADQLTKEKIEELNKTREEQIQKKQKILEELQKVERELQLKTQQQLKKQYLEVKAQRIQLQQQQQQSCQHLGLLTPVGVGEQLSEGDYARLQQVDPVLLKDEPQQTAAQMGFAPIQPLAMPQALPLAAGPLPPGSIANLTELQGVIVGQPVLGQAQLAGLGQGILTETQQGLMVASPAQTLNDTLDDIMAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQ

SEQ ID NO: 5167 - protein, 2487 aa, Homo sapiens
  Payload ID: 1116;
  Gene Symbol: ANKRD17;
  Gene Name: ankyrin repeat domain 17;
  ENSP ID: ENSP00000453434
  MOD_RES (1)..(1): Any amino acid
XEEEEDDDDEEEEVSEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAASKQKSSSHLPANSQDVQGYITNQSPESIVEEAQGKLTELEQRIKEAIEKNAQLQSLELAHADQLTKEKIEELNKTREEQIQKKQKILEELQKVERELQLKTQQQLKKQYLEVKAQRIQLQQQQQQSCQHLGLLTPVGVGEQLSEGDYARLQQVDPVLLKDEPQQTAAQMGFAPIQPLAMPQALPLAAGPLPPGSIANLTELQGVIVGQPVLGQAQLAGLGQGILTETQQGLMVASPAQTLNDTLDDIMAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKLKVEDEPEVLTEPPSATTTTTIGISATWTTLAGSHGKRNNTITTTSSKRKNRKNKITPENVQIIFDDPLPISYSQPEKVNGESKSSSTSESGDSDNMRISSCSDESSNSNSSRKSDNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNRLKSSSANSKIGSSAPTTTAANTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTTTTSSSASTVPGTSTNGSPSSPSVRRQLFVTVVKTSNATTTTVTTTASNNNTAPTNATYPMPTAKEHYPVSSPSSPSPPAQPGGVSRNSPLDCGSASPNKVASSSEQEAGSPPVVETTNTRPPNSSSSSGSSSAHSNQQQPPGSVSQEPRPPLQQSQVPPPEVRMTVPPLATSSAPVAVPSTAPVTYPMPQTPMGCPQPTPKMETPAIRPPPHGTTAPHKNSASVQNSSVAVLSVNHIKRPHSVPSSVQLPSTLSTQSACQNSVHPANKPIAPNFSAPLPFGPFSTLFENSPTSAHAFWGGSVVSSQSTPESMLSGKSSYLPNSDPLHQSDTSKAPGFRPPLQRPAPSPSGIVNMDSPYGSVTPSSTHLGNFASNISGGQMYGPGAPLGGAPAAANFNRQHFSPLSLLTPCSSASNDSSAQSVSSGVRAPSPAPSSVPLGSEKPSNVSQDRKVPVPIGTERSARIRQTGTSAPSVIGSNLSTSVGHSGIWSFEGIGGNQDKVDWCNPGMGNPMIHRPMSDPGVFSQHQAMERDSTGIVTPSGTFHQHVPAGYMDFPKVGGMPFSVYGNAMIPPVAPIPDGAGGPIFNGPHAADPSWNSLIKMVSSSTENNGPQTVWTGPWAPHMNSVHMNQLG

SEQ ID NO: 5168 - protein, 992 aa, Homo sapiens
  Payload ID: 1117;
  Gene Symbol: ANKRD18A;
  Gene Name: ankyrin repeat domain 18A;
  Uniprot ID:  Q8IVF6;
  ENSP ID: ENSP00000382610
MRKLFSFGRRLGQALLSSMDQEYAGPGYDIRDWELRKIHRAAIKGDAAEVERCLTRRFRDLDARDRKDRTVLHLACAHGRVQVVTLLLHRRCQIDICDRLNRTPLMKAVHSQEEACAIVLLECGANPNIEDIYGNTALHYAVYNKGTSLAERLLSHHANIEALNKEGNTPLLFAINSRRQHMVEFLLKNQANIHAVDNFKRTALILAVQHNLSSIVTLLLQQNIRISSQDMFGQTAEDYALCSDLRSIRQQILEHKNKMLKNHLRNDNQETAAMKPANLKKRKERAKAEHNLKVASEEKQERLQRSENKQPQDSQSYGKKKDAMYGNFMLKKDIAMLKEELYAIKNDSLRKEKKYIQEIKSITEINANFEKSVRLNEKMITKTVARYSQQLNDLKAENARLNSELEKEKHNKERLEAEVESLHSSLATAINEYNEIVERKDLELVLWRADDVSRHEKMGSNISQLTDKNELLTEQVHKARVKFNTLKGKLRETRDALREKTLALGSVQLDLRQAQHRIKEMKQMHPNGEAKESQSIGKQNSLEERIRQQELENLLLERQLEDARKEGDNKEIVINIHRDCLENGKEDLLEERNKELMKEYNYLKEKLLQCEKEKAEREVIVREFQEELVDHLKTFSISESPLEGTSHCHINLNETWTSKKKLFQVEIQPEEKHEEFRKLFELISLLNYTADQIRKKNRELEEEATGYKKCLEMTINMLNAFANEDFSCHGDLNTDQLKMDILFKKLKQKFNDLVAEKEAVSSECVNLAKDNEVLHQELLSMRNVQEKCEKLEKDKKMLEEEVLNLKTHMEKDMVELGKLQEYKSELDERAVQEIEKLEEIHLQKQAEYEKQLEQLNKDNTASLKKKELTLKDVECKFSKMKTAYEEVTTELEEFKEAFAGAVKANNSMSKKLMKSDKKIAVISTKLFTEKQRMKYFLSTLPTRPEPELPCVENLNSIELNRKYIPKTAIRIPTSNPQTSNNCKNFLTEVLLC

SEQ ID NO: 5169 - protein, 401 aa, Homo sapiens
  Payload ID: 1117;
  Gene Symbol: ANKRD18A;
  Gene Name: ankyrin repeat domain 18A;
  ENSP ID: ENSP00000473463
EKEKAEREVIVREFQEELVDHLKTFSISESPLEGTSHCHINLNETWTSKKKLFQVEIQPEEKHEEFRKLFELISLLNYTADQIRKKNRELEEEATGYKKCLEMTINMLNAFANEDFSCHGDLNTDQLKMDILFKKLKQKFNDLVAEKEAVSSECVNLAKDNEVLHQELLSMRNVQEKCEKLEKDKKMLEEEVLNLKTHMEKDMVELGKLQEYKSELDERAVQEIEKLEEIHLQKQAEYEKQLEQLNKDNTASLKKKELTLKDVECKFSKMKTAYEEVTTELEEFKEAFAGAVKANNSMSKKLMKSDKKIAVISTKLFTEKQRMKYFLSTLPTRPEPELPCVENLNSIELNRKYIPKTAIRIPTSNPQTSNNCKNFLTEMELDRVEQIITGTKKSMLPKCIN

SEQ ID NO: 5170 - protein, 1011 aa, Homo sapiens
  Payload ID: 1118;
  Gene Symbol: ANKRD18B;
  Gene Name: ankyrin repeat domain 18B;
  Uniprot ID:  A2A2Z9;
  ENSP ID: ENSP00000290943
MRKLLSFGRRLGQALLSSMDQEYAGRGYHIRDWELRKIHRAAIKGDAAEVEHCLTRRFRDLDVRDRKDRTVLHLACAHGRVQVVTLLLDRKCQINICDRLNRTPLMKAVHCQEEACAIILLKRGANPNIKDIYGNTALHYAVYNEGTSLAERLLSHHANIEALNKEGNTPLLFAINSRRQHMVEFLLKNQANIHAVDNFKRTALILAVQHNLSSIVTLLLQQNIHISSQDMFGQTAEDYAFCCDLRSIQQQILEHKNKMLKNHLRNDNQETAAMKPENLKKRKKRKKLKKRKEGAKAEHNLKVASEEKQERLERSENKQPQDSQSYGKKKDEMFGNFMLKRDIAMLKEELYAIKNDSLRKEKKYIQEIKSITEINANFEKSVRLNEEMITKKVAQYSQQLNDLKAENARLNSKLEKEKHNKERLEAEVESLHSNLATAINEYNEILERKDLELVLWRADDVSRHETMGSNISQLTDKNELLTEQVHKARVKFNTLKGKLRETRDALREKTLALESVQLDLKQAQHRIKEMKQMHPNGEAKESQSIGKQNSSEERIRQRELENLLLERQLEDARKEGDNKEIVINIHRDCLENGKEDLLEERNKELMNEYNYLKEKLLQYEKEKAEREVIVREFQEELVDHLKKFSMSESPLEGTSHCHINLDETWTSKKKLFQVEIQPEEKHEEFRKVFELISLLNYTADQIRKKNRELEEEATGYKKCLEMTINMLNAFANEDFSCHGDLNTDQLKMDILFKKLKQKFDDLMAEKEAVSSKCVNLAKDNEVLHQELLSMGKVQEKCEKLEKDKKMLEEKVLNLKTHMEKDMVELGKVQEYKSELDERAMQAIEKLEEIHLQKQAEYEKQLEQLNKDNTASLKKKELTLKDVECKFSKMKTAYEDVTTELEEYKEAFAVALKANSSMSEKITKSDKKIAVISTKLFMEKERMEYFLSTLPMRPDPELPCVENLNSIELNRKYIPKMAIRIPTSNPQTSNNCKNSLTELLLRWALAPIYFLL

SEQ ID NO: 5171 - protein, 401 aa, Homo sapiens
  Payload ID: 1118;
  Gene Symbol: ANKRD18B;
  Gene Name: ankyrin repeat domain 18B;
  ENSP ID: ENSP00000350607
EKEKAEREVIVREFQEELVDHLKKFSMSESPLEGTSHCHINLDETWTSKKKLFQVEIQPEEKHEEFRKVFELISLLNYTADQIRKKNRELEEEATGYKKCLEMTINMLNAFANEDFSCHGDLNTDQLKMDILFKKLKQKFDDLMAEKEAVSSKCVNLAKDNEVLHQELLSMGKVQEKCEKLEKDKKMLEEKVLNLKTHMEKDMVELGKVQEYKSELDERAMQAIEKLEEIHLQKQAEYEKQLEQLNKDNTASLKKKELTLKDVECKFSKMKTAYEDVTTELEEYKEAFAVALKANSSMSEKITKSDKKIAVISTKLFMEKERMEYFLSTLPMRPDPELPCVENLNSIELNRKYIPKMAIRIPTSNPQTSNNCKNSLTEMELDCAEQIITETKKSMLPKCIN

SEQ ID NO: 5172 - protein, 160 aa, Homo sapiens
  Payload ID: 1118;
  Gene Symbol: ANKRD18B;
  Gene Name: ankyrin repeat domain 18B;
  ENSP ID: ENSP00000473566
KQAEYEKQLEQLNKDNTASLKKKELTLKDVECKFSKMKTAYEDVTTELEEYKEAFAVALKANSSMSEKITKSDKKIAVISTKLFMEKERMEYFLSTLPMRPDPELPCVENLNSIELNRKYIPKMAIRIPTSNPQTSNNCKNSLTEVSYMTISLLGFISLI

SEQ ID NO: 5173 - protein, 75 aa, Homo sapiens
  Payload ID: 1118;
  Gene Symbol: ANKRD18B;
  Gene Name: ankyrin repeat domain 18B;
  ENSP ID: ENSP00000474332
  MOD_RES (1)..(1): Any amino acid
XQILEHKNKMLKNHLRNDNQETAAMKPENLKKRKKRKKLKKRKEGAKEHNLKVASEEKQERLERSENKQPQDSQS

SEQ ID NO: 5174 - protein, 327 aa, Homo sapiens
  Payload ID: 1119;
  Gene Symbol: ANKRD2;
  Gene Name: ankyrin repeat domain 2 (stretch responsive muscle);
  Uniprot ID:  Q9GZV1;
  ENSP ID: ENSP00000298808
MAKAPSWAGVGALAYKAPEALWPAEAVMDGTMEDSEAVQRATALIEQRLAQEEENEKLRGDARQKLPMDLLVLEDEKHHGAQSAALQKVKGQERVRKTSLDLRREIIDVGGIQNLIELRKKRKQKKRDALAASHEPPPEPEEITGPVDEETFLKAAVEGKMKVIEKFLADGGSADTCDQFRRTALHRASLEGHMEILEKLLDNGATVDFQDRLDCTAMHWACRGGHLEVVKLLQSHGADTNVRDKEGDTALHDAVRLNRYKIIKLLLLHGADMMTKNLAGKTPTDLVQLWQADTRHALEHPEPGAEHNGLEGPNDSGRETPQPVPAQ

SEQ ID NO: 5175 - protein, 360 aa, Homo sapiens
  Payload ID: 1119;
  Gene Symbol: ANKRD2;
  Gene Name: ankyrin repeat domain 2 (stretch responsive muscle);
  Uniprot ID:  Q9GZV1;
  ENSP ID: ENSP00000306163
MAKAPSWAGVGALAYKAPEALWPAEAVMDGTMEDSEAVQRATALIEQRLAQEEENEKLRGDARQKLPMDLLVLEDEKHHGAQSAALQKVKGQERVRKTSLDLRREIIDVGGIQNLIELRKKRKQKKRDALAASHEPPPEPEEITGPVDEETFLKAAVEGKMKVIEKFLADGGSADTCDQFRRTALHRASLEGHMEILEKLLDNGATVDFQDRLDCTAMHWACRGGHLEVVKLLQSHGADTNVRDKLLSTPLHVAVRTGQVEIVEHFLSLGLEINARDREGDTALHDAVRLNRYKIIKLLLLHGADMMTKNLAGKTPTDLVQLWQADTRHALEHPEPGAEHNGLEGPNDSGRETPQPVPAQ

SEQ ID NO: 5176 - protein, 333 aa, Homo sapiens
  Payload ID: 1119;
  Gene Symbol: ANKRD2;
  Gene Name: ankyrin repeat domain 2 (stretch responsive muscle);
  ENSP ID: ENSP00000359689
MDGTMEDSEAVQRATALIEQRLAQEEENEKLRGDARQKLPMDLLVLEDEKHHGAQSAALQKVKGQERVRKTSLDLRREIIDVGGIQNLIELRKKRKQKKRDALAASHEPPPEPEEITGPVDEETFLKAAVEGKMKVIEKFLADGGSADTCDQFRRTALHRASLEGHMEILEKLLDNGATVDFQDRLDCTAMHWACRGGHLEVVKLLQSHGADTNVRDKLLSTPLHVAVRTGQVEIVEHFLSLGLEINARDREGDTALHDAVRLNRYKIIKLLLLHGADMMTKNLAGKTPTDLVQLWQADTRHALEHPEPGAEHNGLEGPNDSGRETPQPVPAQ

SEQ ID NO: 5177 - protein, 300 aa, Homo sapiens
  Payload ID: 1119;
  Gene Symbol: ANKRD2;
  Gene Name: ankyrin repeat domain 2 (stretch responsive muscle);
  ENSP ID: ENSP00000403114
MDGTMEDSEAVQRATALIEQRLAQEEENEKLRGDARQKLPMDLLVLEDEKHHGAQSAALQKVKGQERVRKTSLDLRREIIDVGGIQNLIELRKKRKQKKRDALAASHEPPPEPEEITGPVDEETFLKAAVEGKMKVIEKFLADGGSADTCDQFRRTALHRASLEGHMEILEKLLDNGATVDFQDRLDCTAMHWACRGGHLEVVKLLQSHGADTNVRDKEGDTALHDAVRLNRYKIIKLLLLHGADMMTKNLAGKTPTDLVQLWQADTRHALEHPEPGAEHNGLEGPNDSGRETPQPVPAQ

SEQ ID NO: 5178 - protein, 823 aa, Homo sapiens
  Payload ID: 1120;
  Gene Symbol: ANKRD20A1;
  Gene Name: ankyrin repeat domain 20 family, member A1;
  Uniprot ID:  Q5TYW2;
  ENSP ID: ENSP00000477695
MKLFGFGSRRGQTAQGSIDHVYTGSGYRIRDSELQKIHRAAVKGDAAEVERCLARRSGDLDALDKQHRTALHLACTSGHVQVVTLLVNRKCQIDVCDKENRTPLIQAVHCQEEACAVILLEHGANPNLKDIYGNTALHYAVYSESTSLAEKLLSHGAHIEALDKDNNTPLLFAIICKKEKMVEFLLKKKASSHAVDRLRRSALMLAVYYDSPGIVNILLKQNIDVFAQDMCGRDAEDYAISHHLTKIQQQILEHKKKILKKEKSDVGSSDESAVSIFHELRVDSLPASDDKDLNVATKQCVPEKVSEPLPGSSHEKGNRIVNGQGEGPPAKHPSLKPSTEVEDPAVKGAVQRKNVQTLRAEQALPVASEEEQERHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNWDFHNHEEMKGLMDENCILKADIAILRQEICTMKNDNLEKENKYLKDIKIVKETNAALEKYIKLNEEMITETAFRYQQELNDLKAENTRLNAELLKEKESKKRLEADIESYQSRLAAAISKHSESVKTERNLKLALERTRDVSVQVEMSSAISKVKAENEFLTEQLSETQIKFNALKDKFRKTRDSLRKKSLALETVQNDLSQTQQQTQEMKEMYQNAEAKVNNSTGKWNCVEERICHLQRENAWLVQQLDDVHQKEDHKEIVTNIQRGFIESGKKDLVLEEKSKKLMNECDHLKESLFQYEREKTEGVVSIKEDKYFQTSRKTI

SEQ ID NO: 5179 - protein, 185 aa, Homo sapiens
  Payload ID: 1120;
  Gene Symbol: ANKRD20A1;
  Gene Name: ankyrin repeat domain 20 family, member A1;
  ENSP ID: ENSP00000481217
MKLFGFGSRRGQTAQGSIDHVYTGSGYRIRDSELQKIHRAAVKGDAAEVERCLARRSGDLDALDKQHRTALHLACTSGHVQVVTLLVNRKCQIDVCDKENRTPLIQAVHCQEEACAVILLEHGANPNLKDIYGNTALHYAVYSESTSLAEKLLSHGAHIEALDKQCVPEKVSEPLPGSSHEKGNR

SEQ ID NO: 5180 - protein, 95 aa, Homo sapiens
  Payload ID: 1120;
  Gene Symbol: ANKRD20A1;
  Gene Name: ankyrin repeat domain 20 family, member A1;
  ENSP ID: ENSP00000483923
MKLFGFGSRRGQTAQGSIDHVYTGSGYRIRDSELQKIHRAAVKGDAAEVERCLARRSGDLDALDKQHREFFQIKSSNTLKVGKVPFSRSTSYLYT

SEQ ID NO: 5181 - protein, 823 aa, Homo sapiens
  Payload ID: 1121;
  Gene Symbol: ANKRD20A2;
  Gene Name: ankyrin repeat domain 20 family, member A2;
  Uniprot ID:  Q5SQ80;
  ENSP ID: ENSP00000366826
MKLFGFGSRRGQTAQGSIDHVYTGSGYRIRDSELQKIHRAAVKGDAAEVERCLARRSGDLDALDKQHRTALHLACASGHVQVVTLLVNRKCQIDVCDKENRTPLIQAVHCQEEACAVILLEHGANPNLKDIYGNTALHYAVYSESTSLAEKLLSHGAHIEALDKDNNTPLLFAIICKKEKMVEFLLKRKASSHAVDRLRRSALMLAVYYDSPGIVNILLKQNIDVFAQDMCGRDAEDYAISHHLTKIQQQILEHKKKILKKEKSDVGSSDESAVSIFHELRVDSLPASDDKDLNVATKQCVPEKVSEPLPGSSHEKGNRIVNGQGEGPPAKHPSLKPSTEVEDPAVKGAVQRKNVQTLRAEQALPVASEEEQERHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNRDFHNHEEMKGLMDENCILKADIAILRQEICTMKNDNLEKENKYLKDIKIVKETNAALEKYIKLNEEMITETAFRYQQELNDLKAENTRLNAELLKEKESKKRLEADIESYQSRLAAAISKHSESVKTERNLKLALERTRDVSVQVEMSSAISKVKDENEFLTEQLSETQIKFNALKDKFRKTRDSLRKKSLALETVQNDLSQTQQQTQEMKEMYQNAEAKVNNSTGKWNCVEERICHLQRENAWLVQQLDDVHQKEDHKEIVTNIQRGFIESGKKDLVLEEKSKKLMNECDHLKESLFQYEREKTEGVVSIKEDKYFQTSRKKI

SEQ ID NO: 5182 - protein, 142 aa, Homo sapiens
  Payload ID: 1121;
  Gene Symbol: ANKRD20A2;
  Gene Name: ankyrin repeat domain 20 family, member A2;
  ENSP ID: ENSP00000484370
MKLFGFGSRRGQTAQGSIDHVYTGSGYRIRDSELQKIHRAAVKGDAAEVERCLARRSGDLDALDKQHRLSIARKRLVPLFCWNMAPIQTLRISTATLLSIMPCIVRAPHWQKNCFPMVHILKHWTRYRSINFLSKIFVLTLT

SEQ ID NO: 5183 - protein, 95 aa, Homo sapiens [sequence omitted]

SEQ ID NO: 5184 - protein, 823 aa, Homo sapiens
  Payload ID: 1122;
  Gene Symbol: ANKRD20A3;
  Gene Name: ankyrin repeat domain 20 family, member A3;
  Uniprot ID:  Q5VUR7;
  ENSP ID: ENSP00000482325
MKLFGFGSRRGQTAQGSIDHVYTGSGYRIRDSELQKIHRAAVKGDAAEVERCLARRSGDLDALDKQHRTALHLACASGHVQVVTLLVNRKCQIDVCDKENRTPLIQAVHCQEEACAVILLEHGANPNLKDIYGNTALHYAVYSESTSLAEKLLSHGAHIEALDKDNNTPLLFAIICKKEKMVEFLLKRKASSHAVDRLRRSALMLAVYYDSPGIVNILLKQNIDVFAQDMCGRDAEDYAISHHLTKIQQQILEHKKKILKKEKSDVGSSDESAVSIFHELRVDSLPASDDKDLNVATKQCVPEKVSEPLPGSSHEKGNRIVNGQGEGPPAKHPSLKPSTEVEDPAVKGAVQRKNVQTLRAEQALPVASEEEQERHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNRDFHNHEEMKGLMDENCILKADIAILRQEICTMKNDNLEKENKYLKDIKIVKETNAALEKYIKLNEEMITETAFRYQQELNYLKAENTRLNAELLKEKESKKRLEADIESYQSRLAAAISKHSESVKTERNLKLALERTRDVSVQVEMSSAISKVKDENEFLTEQLSETQIKFNALKDKFRKTRDSLRKKSLALETVQNDLSQTQQQTQEMKEMYQNAEAKVNNSTGKWNCVEERICHLQRENAWLVQQLDDVHQKEDHKEIVTNIQRGFIESGKKDLVLEEKSKKLMNECDHLKESLFQYEREKTEGVVSIKEDKYFQTSRKTI

SEQ ID NO: 5185 - protein, 823 aa, Homo sapiens
  Payload ID: 1123;
  Gene Symbol: ANKRD20A4;
  Gene Name: ankyrin repeat domain 20 family, member A4;
  Uniprot ID:  Q4UJ75;
  ENSP ID: ENSP00000349891
MKLFGFGSRRGQTAQGSIDHVYTGSGYRIRDSELQKIHRAAVKGDAAEVERCLARRSGELDALDKQHRTALHLACASGHVQVVTLLVNRKCQIDVCDKENRTPLIQAVHCQEEACAVILLEHGANPNLKDIYGNTALHYAVYSESTSLAEKLLSHGAHIEALDKDNNTPLLFAIICKKEKMVEFLLKKKASSHAVDRLRRSALMLAVYYDSPGIVNILLKQNIDVFAQDMCGRDAEDYAISHHLTKIQQQILEHKKKILKKEKSDVGSSDESAVSIFHELRVDSLPASDDKDLNVATKQCVPEKVSEPLPGSSHEKGNRIVNGQGEGPPAKHPSLKPSTEVEDPAVKGAVQRKNVQTLRAEQALPVASEEEQQRHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNWDFHNHEEMKGLMDENCILKADIAILRQEICTMKNDNLEKENKYLKDIKIVKETNAALEKYIKLNEEMITETAFRYQQELNDLKAENTRLNAELLKEKESKKRLEADIESYQSRLAAAISKHSESVKTERNLKLALERTQDVSVQVEMSSAISKVKDENEFLTEQLSETQIKFNALKDKFRKTRDSLRKKSLALETVQNNLSQTQQQTQEMKEMYQNAEAKVNNSTGKWNCVEERICHLQRENAWLVQQLDDVHQKEDHKEIVTNIQRGFIESGKKDFVLEEKSKKLMNECDHLKESLFQYEREKTEVVVSIKEDKYFQTSRKKI

SEQ ID NO: 5186 - protein, 142 aa, Homo sapiens
  Payload ID: 1123;
  Gene Symbol: ANKRD20A4;
  Gene Name: ankyrin repeat domain 20 family, member A4;
  ENSP ID: ENSP00000478208
MKLFGFGSRRGQTAQGSIDHVYTGSGYRIRDSELQKIHRAAVKGDAAEVERCLARRSGELDALDKQHRLSIARKRLVPLFCWNMAPIQTLRISTATLLSIMPCIVRAPHWQKNCFPMVHILKHWTRYRSINFLSKIFVLTLT

SEQ ID NO: 5187 - protein, 191 aa, Homo sapiens
  Payload ID: 1124;
  Gene Symbol: ANKRD22;
  Gene Name: ankyrin repeat domain 22;
  Uniprot ID:  Q5VYY1;
  ENSP ID: ENSP00000360998
MGILYSEPICQAAYQNDFGQVWRWVKEDSSYANVQDGFNGDTPLICACRRGHVRIVSFLLRRNANVNLKNQKERTCLHYAVKKKFTFIDYLLIILLMPVLLIGYFLMVSKTKQNEALVRMLLDAGVEVNATDCYGCTALHYACEMKNQSLIPLLLEARADPTIKNKHGESSLDIARRLKFSQIELMLRKAL

SEQ ID NO: 5188 - protein, 305 aa, Homo sapiens
  Payload ID: 1125;
  Gene Symbol: ANKRD23;
  Gene Name: ankyrin repeat domain 23;
  Uniprot ID:  Q86SG2;
  ENSP ID: ENSP00000321679
MDFISIQQLVSGERVEGKVLGFGHGVPDPGAWPSDWRRGPQEAVAREKLKLEEEKKKKLERFNSTRFNLDNLADLENLVQRRKKRLRHRVPPRKPEPLVKPQSQAQVEPVGLEMFLKAAAENQEYLIDKYLTDGGDPNAHDKLHRTALHWACLKGHSQLVNKLLVAGATVDARDLLDRTPVFWACRGGHLVILKQLLNQGARVNARDKIGSTPLHVAVRTRHPDCLEHLIECGAHLNAQDKEGDTALHEAVRHGSYKAMKLLLLYGAELGVRNAASVTPVQLARDWQRGIREALQAHVAHPRTRC

SEQ ID NO: 5189 - protein, 263 aa, Homo sapiens
  Payload ID: 1125;
  Gene Symbol: ANKRD23;
  Gene Name: ankyrin repeat domain 23;
  Uniprot ID:  Q86SG2;
  ENSP ID: ENSP00000333108
MDFISIQQLVSGERVEGKVLGFGHGVPDPGAWPSDWRRGPQEAVAREKLKLEEEKKKKLERFNSTRFNLDNLADLENLVQRRKKRLRHRVPPRKPEPLVKLHRTALHWACLKGHSQLVNKLLVAGATVDARDLLDRTPVFWACRGGHLVILKQLLNQGARVNARDKIGSTPLHVAVRTRHPDCLEHLIECGAHLNAQDKEGDTALHEAVRHGSYKAMKLLLLYGAELGVRNAASVTPVQLARDWQRGIREALQAHVAHPRTRC

SEQ ID NO: 5190 - protein, 305 aa, Homo sapiens; identical to SEQ ID NO: 5188
  Payload ID: 1125;
  Gene Symbol: ANKRD23;
  Gene Name: ankyrin repeat domain 23;
  Uniprot ID:  Q86SG2;
  ENSP ID: ENSP00000398987

SEQ ID NO: 5191 - protein, 1236 aa, Homo sapiens
  Payload ID: 1126;
  Gene Symbol: ANKRD24;
  Gene Name: ankyrin repeat domain 24;
  Uniprot ID:  Q8TF21;
  ENSP ID: ENSP00000262970
MQPAACAGEGAGPPAPRPPHPPGDKVRRGRGGAPSLSPQPPAPYLGLPIPSRGGGGWRGGQGGGGGTREGGTGRAGGAGSSGSAQPRPPAAPRGPSRPSGRRLLLEPRAPPAPRAPDAMKQLCLCAAASFASQDWGKSDERLLQAVENNDAPRVAALIARKGLVPTKLDPEGKSAFHLAAMRGAASCLEVMIAHGSNVMSADGAGYNALHLAAKYGHPQCLKQLLQASCVVDVVDSSGWTALHHAAAGGCLSCSEVLCSFKAHLNPQDRSGATPLIIAAQMCHTDLCRLLLQQGAAANDQDLQGRTALMLACEGASPETVEVLLQGGAQPGITDALGQDAAHYGALAGDKLILHLLQEAAQRPSPPSALTEDDSGEASSQNSMSSHGKQGAPKKRKAPPPPASIPMPDDRDAYEEIVRLRQERGRLLQKIRGLEQHKERRQQESPEASSLHILERQVQELQQLLVERQEEKESLGREVESLQSRLSLLENERENTSYDVTTLQDEEGELPDLPGAEVLLSRQLSPSAQEHLASLQEQVAVLTRQNQELMEKVQILENFEKDETQMEVEALAEVIPLALYDSLRAEFDQLRRQHAEALQALRQQETREVPREEGAACGESEVAGATATKNGPTHMELNGSVAPETKVNGAETIDEEAAGDETMEARTMEAEATGAEATGAEATGAKVTETKPTGAEVREMETTEEEANMETKPTGAQATDTETTGVEAMGVEATKTKAEEAEMQAYGVGAGQAEPPVTGTTNMEATGSRATGMESTGVSATGVENPGVEATVPGISAGPILHPGAAEASEKLQVELETRIRGLEEALRQREREAAAELEAALGKCEAAEAEAGRLRERVREAEGSGASGGGGGDTTQLRAALEQAREDLRDRDSRLRELEAASACLDEARASRLLAEEEARGLRAELAQREEARLEQSRELEVLREQLATARATGEQQRTAAAELGRARDAAEARVAELPAACEEARQGLAELREASEALRQSVVPASEHRRLQEEALELRGRAASLEQEVVATGKEAARLRAELERERVCSVALSEHERIVGTLQANVAQLEGQLEELGRRHEKTSAEVFQVQREALFMKSERHAAEAQLATAEQQLRGLRTEAERARQAQSRAQEALDKAKEKDKKITELSKEVFNLKEALKEQPAALATPEVEALRDQVKDLQQQLQEAARDHSSVVALYRSHLLYAIQGQMDEDVQRILSQILQMQRLQAQGR

SEQ ID NO: 5192 - protein, 1146 aa, Homo sapiens
  Payload ID: 1126;
  Gene Symbol: ANKRD24;
  Gene Name: ankyrin repeat domain 24;
  Uniprot ID:  Q8TF21;
  ENSP ID: ENSP00000321731
MKTLRARFKKTELRLSPTDLGSCPPCGPCPIPKPAARGRRQSQDWGKSDERLLQAVENNDAPRVAALIARKGLVPTKLDPEGKSAFHLAAMRGAASCLEVMIAHGSNVMSADGAGYNALHLAAKYGHPQCLKQLLQASCVVDVVDSSGWTALHHAAAGGCLSCSEVLCSFKAHLNPQDRSGATPLIIAAQMCHTDLCRLLLQQGAAANDQDLQGRTALMLACEGASPETVEVLLQGGAQPGITDALGQDAAHYGALAGDKLILHLLQEAAQRPSPPSALTEDDSGEASSQNSMSSHGKQGAPKKRKAPPPPASIPMPDDRDAYEEIVRLRQERGRLLQKIRGLEQHKERRQQESPEASSLHILERQVQELQQLLVERQEEKESLGREVESLQSRLSLLENERENTSYDVTTLQDEEGELPDLPGAEVLLSRQLSPSAQEHLASLQEQVAVLTRQNQELMEKVQILENFEKDETQMEVEALAEVIPLALYDSLRAEFDQLRRQHAEALQALRQQETREVPREEGAACGESEVAGATATKNGPTHMELNGSVAPETKVNGAETIDEEAAGDETMEARTMEAEATGAEATGAEATGAKVTETKPTGAEVREMETTEEEANMETKPTGAQATDTETTGVEAMGVEATKTKAEEAEMQAYGVGAGQAEPPVTGTTNMEATGSRATGMESTGVSATGVENPGVEATVPGISAGPILHPGAAEASEKLQVELETRIRGLEEALRQREREAAAELEAALGKCEAAEAEAGRLRERVREAEGSGASGGGGGDTTQLRAALEQAREDLRDRDSRLRELEAASACLDEARASRLLAEEEARGLRAELAQREEARLEQSRELEVLREQLATARATGEQQRTAAAELGRARDAAEARVAELPAACEEARQGLAELREASEALRQSVVPASEHRRLQEEALELRGRAASLEQEVVATGKEAARLRAELERERVCSVALSEHERIVGTLQANVAQLEGQLEELGRRHEKTSAEVFQVQREALFMKSERHAAEAQLATAEQQLRGLRTEAERARQAQSRAQEALDKAKEKDKKITELSKEVFNLKEALKEQPAALATPEVEALRDQVKDLQQQLQEAARDHSSVVALYRSHLLYAIQGQMDEDVQRILSQILQMQRLQAQGR

SEQ ID NO: 5193 - protein, 839 aa, Homo sapiens
  Payload ID: 1126;
  Gene Symbol: ANKRD24;
  Gene Name: ankyrin repeat domain 24;
  ENSP ID: ENSP00000470227
MKTLRARFKKTESQDWGKSDERLLQAVENNDAPRVAALIARKGLVPTKLDPEGKSAFHLAAMRGAASCLEVMIAHGSNVMSADGAGYNALHLAAKYGHPQCLKQLLQASCVVDVVDSSGWTALHHAAAGGCLSCSEVLCSFKAHLNPQDRSGATPLIIAAQMCHTDLCRLLLQQGAAANDQDLQGRTALMLACEGASPETVEVLLQGGAQPGITDALGQDAAHYGALAGDKLILHLLQEAAQRPSPPSALTEDDSGEASSQNSMSSHGKQGAPKKRKAPPPPASIPMPDDRDAYEEIVRLRQERGRLLQKIRGLEQHKERRQQESPEASSLHILERQVQELQQLLVERQEEKESLGREVESLQSRLSLLENERENTSYDVTTLQDEEGELPDLPGAEVLLSRQLSPSAQEHLASLQEQVAVLTRQNQELMEKVQILENFEKDETQMEVEALAEVIPLALYDSLRAEFDQLRRQHAEALQALRQQETREVPREEGAACGESEVAGATATKNGPTHMELNGSVAPETKVNGAETIDEEAAGDETMEARTMEAEATGAEATGAEATGAKVTETKPTGAEVREMETTEEEANMETKPTGAQATDTETTGVEAMGVEATKTKAEEAEMQAYGVGAGQAEPPVTGTTNMEATGSRATGMESTGVSATGVENPGVEATVPGISAGPILHPGAAEASEKLQVELETRIRGLEEALRQREREAAAELEAALGKCEAAEAEAGRLRERVREAEGSGASGGGGGDTTQLRAALEQAREDLRDRDSRLRELEAASACLDEARASRLLAEEEARGLRAELAQREEARLEQSRELEVLREQLATARATGEQQR

SEQ ID NO: 5194 - protein, 1146 aa, Homo sapiens; identical to SEQ ID NO: 5192
  Payload ID: 1126;
  Gene Symbol: ANKRD24;
  Gene Name: ankyrin repeat domain 24;
  Uniprot ID:  Q8TF21;
  ENSP ID: ENSP00000471252

SEQ ID NO: 5195 - protein, 163 aa, Homo sapiens
  Payload ID: 1126;
  Gene Symbol: ANKRD24;
  Gene Name: ankyrin repeat domain 24;
  ENSP ID: ENSP00000471346
  MOD_RES (1)..(1): Any amino acid
XPRGPSRPSGRRLLLEPRAPPAPRAPDAMKQLCLCAAASFASQDWGKSDERLLQAVENNDAPRVAALIARKGLVPTKLDPEGKSAFHLAAMRGAASCLEVMIAHGSNVMSADGAGYNALHLAAKYGHPQCLKQLLQRQGLTVLAQRLVAVSPAQRCSAPLRHI

SEQ ID NO: 5196 - protein, 1710 aa, Homo sapiens
  Payload ID: 1127;
  Gene Symbol: ANKRD26;
  Gene Name: ankyrin repeat domain 26;
  Uniprot ID:  Q9UPS8;
  ENSP ID: ENSP00000365255
MKKIFSKKGESPLGSFARRQRSSAGGGGEPGEGAYSQPGYHVRDRDLGKIHKAASAGNVAKVQQILLLRKNGLNDRDKMNRTALHLACANGHPEVVTLLVDRKCQLNVCDNENRTALMKAVQCQEEKCATILLEHGADPNLADVHGNTALHYAVYNEDISVATKLLLYDANIEAKNKDDLTPLLLAVSGKKQQMVEFLIKKKANVNAVDKLESSHQLISEYKEERIPKHSSQNSNSVDESSEDSLSRLSGKPGVDDSWPTSDDEDLNFDTKNVPKPSLAKLMTASQQSRKNLEATYGTVRTGNRTLFEDRDSDSQDEVVVESLPTTSIKVQCFSHPTYQSPDLLPKPSHKSLANPGLMKEEPTKPGIAKKENGIDIIESAPLEQTNNDNLTYVDEVHKNNRSDMMSALGLGQEEDIESPWDSESISENFPQKYVDPLAGAADGKEKNIGNEQAEDVFYIPSCMSGSRNFKMAKLEDTRNVGMPVAHMESPERYLHLKPTIEMKDSVPNKAGGMKDVQTSKAAEHDLEVASEEEQEREGSENNQPQVEEERKKHRNNEMEVSANIHDGATDDAEDDDDDDGLIQKRKSGETDHQQFPRKENKEYASSGPALQMKEVKSTEKEKRTSKESVNSPVFGKASLLTGGLLQVDDDSSLSEIDEDEGRPTKKTSNEKNKVKNQIQSMDDVDDLTQSSETASEDCELPHSSYKNFMLLIEQLGMECKDSVSLLKIQDAALSCERLLELKKNHCELLTVKIKKMEDKVNVLQRELSETKEIKSQLEHQKVEWERELCSLRFSLNQEEEKRRNADTLYEKIREQLRRKEEQYRKEVEVKQQLELSLQTLEMELRTVKSNLNQVVQERNDAQRQLSREQNARMLQDGILTNHLSKQKEIEMAQKKMNSENSHSHEEEKDLSHKNSMLQEEIAMLRLEIDTIKNQNQEKEKKCFEDLKIVKEKNEDLQKTIKQNEETLTQTISQYNGRLSVLTAENAMLNSKLENEKQSKERLEAEVESYHSRLAAAIHDRDQSETSKRELELAFQRARDECSRLQDKMNFDVSNLKDNNEILSQQLFKTESKLNSLEIEFHHTRDALREKTLGLERVQKDLSQTQCQMKEMEQKYQNEQVKVNKYIGKQESVEERLSQLQSENMLLRQQLDDAHNKADNKEKTVINIQDQFHAIVQKLQAESEKQSLLLEERNKELISECNHLKERQYQYENEKAEREVVVRQLQQELADTLKKQSMSEASLEVTSRYRINLEDETQDLKKKLGQIRNQLQEAQDRHTEAVRCAEKMQDHKQKLEKDNAKLKVTVKKQMDKIEELQKNLLNANLSEDEKEQLKKLMELKQSLECNLDQEMKKNVELEREITGFKNLLKMTRKKLNEYENGEFSFHGDLKTSQFEMDIQINKLKHKIDDLTAELETAGSKCLHLDTKNQILQEELLSMKTVQKKCEKLQKNKKKLEQEVINLRSHIERNMVELGQVKQYKQEIEERARQEIAEKLKEVNLFLQAQAASQENLEQFRENNFASMKSQMELRIKDLESELSKIKTSQEDFNKTELEKYKQLYLEELKVRKSLSSKLTKTNERLAEVNTKLLVEKQQSRSLFTTLTTRPVMEPPCVGNLNNSLDLNRKLIPRENLVISTSNPRASNNSMENYLSKMQQELEKNITRELKEAAAELESGSIASPLGSTDESNLNQDLVWKASREYVQVLKKNYMI

SEQ ID NO: 5197 - protein, 213 aa, Homo sapiens
  Payload ID: 1127;
  Gene Symbol: ANKRD26;
  Gene Name: ankyrin repeat domain 26;
  ENSP ID: ENSP00000394152
  MOD_RES (1)..(1): Any amino acid
XFRENNFASMKSQMELRIKDLESELSKIKTSQEDFNKTELEKYKQLYLEELKVRKSLSSKLTKTNERLAEVNTKLLVEKQQSRSLFTTLTTRPVMEPPCVGNLNNSLDLNRKLIPRENLVISTSNPRASNNSMENYLSKMQQELEKNITRELKEAAAELESGSIASPLGSTDESNLNQDLVWKASREYGPSDETPHDYVLMTDQCLTSRTDLQ

SEQ ID NO: 5198 - protein, 1726 aa, Homo sapiens
  Payload ID: 1127;
  Gene Symbol: ANKRD26;
  Gene Name: ankyrin repeat domain 26;
  ENSP ID: ENSP00000405112
MKKIFSKKGESPLGSFARRQRSSAGGGGEPGEGAYSQPGYHVRDRDLGKIHKAASAGNVAKVQQILLLRKNGLNDRDKMNRTALHLACANGHPEVVTLLVDRKCQLNVCDNENRTALMKAVQCQEEKCATILLEHGADPNLADVHGNTALHYAVYNEDISVATKLLLYDANIEAKNKDDLTPLLLAVSGKKQQMVEFLIKKKANVNAVDKLESSHQLISEYKEERIPKHSSQNSNSVDESSEDSLSSLFYFIFFETKSCTVAQAGVLQHDLSSLQSLLPGFTQFFCLHLPSSWDHRLSGKPGVDDSWPTSDDEDLNFDTKNVPKPSLAKLMTASQQSRKNLEATYGTVRTGNRTLFEDRDSDSQDEVVVESLPTTSIKVQCFSHPTYQSPDLLPKPSHKSLANPGLMKEEPTKPGIAKKENGIDIIESAPLEQTNNDNLTYVDEVHKNNRSDMMSALGLGQEEDIESPWDSESISENFPQKYVDPLAGAADGKEKNIGNEQAEESPERYLHLKPTIEMKDSVPNKAGGMKDVQTSKAAEHDLEVASEEEQEREGSENNQPQVEEERKKHRNNEMEVSANIHDGATDDAEDDDDDDGLIQKRKSGETDHQQFPRKENKEYASSGPALQMKEVKSTEKEKRTSKESVNSPVFGKASLLTGGLLQVDDDSSLSEIDEDEGRPTKKTSNEKNKVKNQIQSMDDVDDLTQSSETASEDCELPHSSYKNFMLLIEQLGMECKDSVSLLKIQDAALSCERLLELKKNHCELLTVKIKKMEDKVNVLQRELSETKEIKSQLEHQKVEWERELCSLRFSLNQEEEKRRNADTLYEKIREQLRRKEEQYRKEVEVKQQLELSLQTLEMELRTVKSNLNQVVQERNDAQRQLSREQNARMLQDGILTNHLSKQKEIEMAQKKMNSENSHSHEEEKDLSHKNSMLQEEIAMLRLEIDTIKNQNQEKEKKCFEDLKIVKEKNEDLQKTIKQNEETLTQTISQYNGRLSVLTAENAMLNSKLENEKQSKERLEAEVESYHSRLAAAIHDRDQSETSKRELELAFQRARDECSRLQDKMNFDVSNLKDNNEILSQQLFKTESKLNSLEIEFHHTRDALREKTLGLERVQKDLSQTQCQMKEMEQKYQNEQVKVNKYIGKQESVEERLSQLQSENMLLRQQLDDAHNKADNKEKTVINIQDQFHAIVQKLQAESEKQSLLLEERNKELISECNHLKERQYQYENEKAEREVVVRQLQQELADTLKKQSMSEASLEVTSRYRINLEDETQDLKKKLGQIRNQLQEAQDRHTEAVRCAEKMQDHKQKLEKDNAKLKVTVKKQMDKIEELQKNLLNANLSEDEKEQLKKLMELKQSLECNLDQEMKKNVELEREITGFKNLLKMTRKKLNEYENGEFSFHGDLKTSQFEMDIQINKLKHKIDDLTAELETAGSKCLHLDTKNQILQEELLSMKTVQKKCEKLQKNKKKLEQEVINLRSHIERNMVELGQVKQYKQEIEERARQEIAEKLKEVNLFLQAQAASQENLEQFRENNFASMKSQMELRIKDLESELSKIKTSQEDFNKTELEKYKQLYLEELKVRKSLSSKLTKTNERLAEVNTKLLVEKQQSRSLFTTLTTRPVMEPPCVGNLNNSLDLNRKLIPRENLVISTSNPRASNNSMENYLSKMQQELEKNITRELKEAAAELESGSIASPLGSTDESNLNQDLVWKASREYVQVLKKNYMI

SEQ ID NO: 5199 - protein, 1050 aa, Homo sapiens
  Payload ID: 1128;
  Gene Symbol: ANKRD27;
  Gene Name: ankyrin repeat domain 27 (VPS9 domain);
  Uniprot ID:  Q96NW4;
  ENSP ID: ENSP00000304292
MALYDEDLLKNPFYLALQKCRPDLCSKVAQIHGIVLVPCKGSLSSSIQSTCQFESYILIPVEEHFQTLNGKDVFIQGNRIKLGAGFACLLSVPILFEETFYNEKEESFSILCIAHPLEKRESSEEPLAPSDPFSLKTIEDVREFLGRHSERFDRNIASFHRTFRECERKSLRHHIDSANALYTKCLQQLLRDSHLKMLAKQEAQMNLMKQAVEIYVHHEIYNLIFKYVGTMEASEDAAFNKITRSLQDLQQKDIGVKPEFSFNIPRAKRELAQLNKCTSPQQKLVCLRKVVQLITQSPSQRVNLETMCADDLLSVLLYLLVKTEIPNWMANLSYIKNFRFSSLAKDELGYCLTSFEAAIEYIRQGSLSAKPPESEGFGDRLFLKQRMSLLSQMTSSPTDCLFKHIASGNQKEVERLLSQEDHDKDTVQKMCHPLCFCDDCEKLVSGRLNDPSVVTPFSRDDRGHTPLHVAAVCGQASLIDLLVSKGAMVNATDYHGATPLHLACQKGYQSVTLLLLHYKASAEVQDNNGNTPLHLACTYGHEDCVKALVYYDVESCRLDIGNEKGDTPLHIAARWGYQGVIETLLQNGASTEIQNRLKETPLKCALNSKILSVMEAYHLSFERRQKSSEAPVQSPQRSVDSISQESSTSSFSSMSASSRQEETKKDYREVEKLLRAVADGDLEMVRYLLEWTEEDLEDAEDTVSAADPEFCHPLCQCPKCAPAQKRLAKVPASGLGVNVTSQDGSSPLHVAALHGRADLIPLLLKHGANAGARNADQAVPLHLACQQGHFQVVKCLLDSNAKPNKKDLSGNTPLIYACSGGHHELVALLLQHGASINASNNKGNTALHEAVIEKHVFVVELLLLHGASVQVLNKRQRTAVDCAEQNSKIMELLQVVPSCVASLDDVAETDRKEYVTVKIRKKWNSKLYDLPDEPFTRQFYFVHSAGQFKGKTSREIMARDRSVPNLTEGSLHEPGRQSVTLRQNNLPAQSGSHAAEKGNSDWPERPGLTQTGPGHRRMLRRHTVEDAVVSQGPEAAGPLSTPQEVSASRS

SEQ ID NO: 5200 - protein, 174 aa, Homo sapiens
  Payload ID: 1128;
  Gene Symbol: ANKRD27;
  Gene Name: ankyrin repeat domain 27 (VPS9 domain);
  ENSP ID: ENSP00000464751
MCADDLLSVLLYLLVKTEIPNWMANLSYIKNFRFSSLAKDELGYCLTSFEAAIEYIRQGSLSAKPPESEGFGDRLFLKQRMSLLSQMTSSPTDCLFKHIASGNQKEVERLLSQEDHDKDTVQKMCHPLCFCDDCEKLVSGRLNDPSVVTPFSRDDRGHTPLHVAAVCGQASLID

SEQ ID NO: 5201 - protein, 75 aa, Homo sapiens
  Payload ID: 1128;
  Gene Symbol: ANKRD27;
  Gene Name: ankyrin repeat domain 27 (VPS9 domain);
  ENSP ID: ENSP00000464819
MALYDEDLLKNPFYLALQKCRPDLCSKVAQIHGIVLVPCKGSLSSSIQSTCQFESYILIPVEEHFQTLNGKDVFI

SEQ ID NO: 5202 - protein, 389 aa, Homo sapiens
  Payload ID: 1128;
  Gene Symbol: ANKRD27;
  Gene Name: ankyrin repeat domain 27 (VPS9 domain);
  ENSP ID: ENSP00000466138
MALYDEDLLKNPFYLALQKCRPDLCSKVAQIHGIVLVPCKGSLSSSIQSTCQFESYILIPVEEHFQTLNGKDVFIQGNRIKLGAGFACLLSVPILFEETFYNEKEESFSILCIAHPLEKRESSEEPLAPSDPFSLKTIEDVREFLGRHSERFDRNIASFHRTFRECERKSLRHHIDSANALYTKCLQQLLRDSHLKMLAKQEAQMNLMKQAVEIYVHHEIYNLIFKYVGTMEASEDAAFNKITRSLQDLQQKDIGVKPEFSFNIPRAKRELAQLNKCTSPQQKLVCLRKVVQLITQSPSQRVNLETMCADDLLSVLLYLLVKTEIPNWMANLSYIKNFRFSSLAKDELGYCLTSFEAAIEYIRQGSLSAKPPVRSHPCPGLPLWASWFP

SEQ ID NO: 5203 - protein, 82 aa, Homo sapiens
  Payload ID: 1128;
  Gene Symbol: ANKRD27;
  Gene Name: ankyrin repeat domain 27 (VPS9 domain);
  ENSP ID: ENSP00000466905
MALYDEDLLKNPFYLALQKCRPDLCSKVAQIHGIVLVPCKGSLSSSIQSTCQFESYILIPVEEHFQTLNGKKSLWHPQIPFP

SEQ ID NO: 5204 - protein, 30 aa, Homo sapiens
  Payload ID: 1128;
  Gene Symbol: ANKRD27;
  Gene Name: ankyrin repeat domain 27 (VPS9 domain);
  ENSP ID: ENSP00000467447
MEASEDAAFNKITRSLQDLQQKDIGVKPEF

SEQ ID NO: 5205 - protein, 150 aa, Homo sapiens
  Payload ID: 1128;
  Gene Symbol: ANKRD27;
  Gene Name: ankyrin repeat domain 27 (VPS9 domain);
  ENSP ID: ENSP00000476897
MALYDEDLLKNPFYLALQKCRPDLCSKVAQIHGIVLVPCKGSLSSSIQSTCQFESYILIPVEEHFQTLNGKDVFIQGNRIKLGAGFACLLSVPILFEETFYNEKEESFSILCIAHPLEKRESSEPLAPSDPFSLKTIEDVREFLGRHSER

SEQ ID NO: 5206 - protein, 174 aa, Homo sapiens
  Payload ID: 1128;
  Gene Symbol: ANKRD27;
  Gene Name: ankyrin repeat domain 27 (VPS9 domain);
  ENSP ID: ENSP00000480730
MALYDEDLLKNPFYLALQKCRPDLCSKVAQIHGIVLVPCKGSLSSSIQSTCQFESYILIPVEEHFQTLNGKDVFIQGNRIKLGAGFACLLSVPILFEETFYNEKEESFSILCIAHPLEKRESSEEPLAPSDPFSLKTIEDVREFLGRHSERFDRNIASFHRTFRECERKSSVTT

SEQ ID NO: 5207 - protein, 899 aa, Homo sapiens
  Payload ID: 1129;
  Gene Symbol: ANKRD28;
  Gene Name: ankyrin repeat domain 28;
  Uniprot ID:  O15084;
  ENSP ID: ENSP00000373287
MVKLLLSRGANINAFDKKDRRAIHWAAYMGHIEVVKLLVSHGAEVTCKDKKSYTPLHAAASSGMISVVKYLLDLGVDMNEPNAYGNTPLHVACYNGQDVVVNELIDCGAIVNQKNEKGFTPLHFAAASTHGALCLELLVGNGADVNMKSKDGKTPLHMTALHGRFSRSQTIIQSGAVIDCEDKNGNTPLHIAARYGHELLINTLITSGADTAKRGIHGMFPLHLAALSGFSDCCRKLLSSGFDIDTPDDFGRTCLHAAAAGGNLECLNLLLNTGADFNKKDKFGRSPLHYAAANCNYQCLFALVGSGASVNDLDERGCTPLHYAATSDTDGKCLEYLLRNDANPGIRDKQGYNAVHYSAAYGHRLCLQLIASETPLDVLMETSGTDMLSDSDNRATISPLHLAAYHGHHQALEVLVQSLLDLDVRNSSGRTPLDLAAFKGHVECVDVLINQGASILVKDYILKRTPIHAAATNGHSECLRLLIGNAEPQNAVDIQDGNGQTPLMLSVLNGHTDCVYSLLNKGANVDAKDKWGRTALHRGAVTGHEECVDALLQHGAKCLLRDSRGRTPIHLSAACGHIGVLGALLQSAASMDANPATADNHGYTALHWACYNGHETCVELLLEQEVFQKTEGNAFSPLHCAVINDNEGAAEMLIDTLGASIVNATDSKGRTPLHAAAFTDHVECLQLLLSHNAQVNSVDSTGKTPLMMAAENGQTNTVEMLVSSASAELTLQDNSKNTALHLACSKGHETSALLILEKITDRNLINATNAALQTPLHVAARNGLTMVVQELLGKGASVLAVDENGYTPALACAPNKDVADCLALILATMMPVSSSSPLSSLTFNAINRYTNTSKTVSFEALPIMRNEPSSYCSFNNIGGEQEYLYTDVDELNDSDSETY

SEQ ID NO: 5208 - protein, 1053 aa, Homo sapiens
  Payload ID: 1129;
  Gene Symbol: ANKRD28;
  Gene Name: ankyrin repeat domain 28;
  Uniprot ID:  O15084;
  ENSP ID: ENSP00000382379
MAFLKLRDQPSLVQAIFNGDPDEVRALIFKKEDVNFQDNEKRTPLHAAAYLGDAEIIELLILSGARVNAKDSKWLTPLHRAVASCSEEAVQVLLKHSADVNARDKNWQTPLHIAAANKAVKCAEALVPLLSNVNVSDRAGRTALHHAAFSGHGEMVKLLLSRGANINAFDKKDRRAIHWAAYMGHIEVVKLLVSHGAEVTCKDKKSYTPLHAAASSGMISVVKYLLDLGVDMNEPNAYGNTPLHVACYNGQDVVVNELIDCGAIVNQKNEKGFTPLHFAAASTHGALCLELLVGNGADVNMKSKDGKTPLHMTALHGRFSRSQTIIQSGAVIDCEDKNGNTPLHIAARYGHELLINTLITSGADTAKRGIHGMFPLHLAALSGFSDCCRKLLSSGFDIDTPDDFGRTCLHAAAAGGNLECLNLLLNTGADFNKKDKFGRSPLHYAAANCNYQCLFALVGSGASVNDLDERGCTPLHYAATSDTDGKCLEYLLRNDANPGIRDKQGYNAVHYSAAYGHRLCLQLIASETPLDVLMETSGTDMLSDSDNRATISPLHLAAYHGHHQALEVLVQSLLDLDVRNSSGRTPLDLAAFKGHVECVDVLINQGASILVKDYILKRTPIHAAATNGHSECLRLLIGNAEPQNAVDIQDGNGQTPLMLSVLNGHTDCVYSLLNKGANVDAKDKWGRTALHRGAVTGHEECVDALLQHGAKCLLRDSRGRTPIHLSAACGHIGVLGALLQSAASMDANPATADNHGYTALHWACYNGHETCVELLLEQEVFQKTEGNAFSPLHCAVINDNEGAAEMLIDTLGASIVNATDSKGRTPLHAAAFTDHVECLQLLLSHNAQVNSVDSTGKTPLMMAAENGQTNTVEMLVSSASAELTLQDNSKNTALHLACSKGHETSALLILEKITDRNLINATNAALQTPLHVAARNGLTMVVQELLGKGASVLAVDENGYTPALACAPNKDVADCLALILATMMPVSSSSPLSSLTFNAINRYTNTSKTVSFEALPIMRNEPSSYCSFNNIGGEQEYLYTDVDELNDSDSETY

SEQ ID NO: 5209 - protein, 14 aa, Homo sapiens
  Payload ID: 1129;
  Gene Symbol: ANKRD28;
  Gene Name: ankyrin repeat domain 28;
  ENSP ID: ENSP00000389489
MAFLKLRDQACDWN

SEQ ID NO: 5210 - protein, 722 aa, Homo sapiens
  Payload ID: 1129;
  Gene Symbol: ANKRD28;
  Gene Name: ankyrin repeat domain 28;
  ENSP ID: ENSP00000394845
MLTFRTMKSEPHCTPQLTLEMQKSLNFLFYLEAVQVLLKHSADVNARDKNWQTPLHIAAANKAVKCAEALVPLLSNVNVSDRAGRTALHHAAFSGHGEMVKLLLSRGANINAFDKKDRRAIHWAAYMGHIEVVKLLVSHGAEVTCKDKKSYTPLHAAASSGMISVVKYLLDLGVDMNEPNAYGNTPLHVACYNGQDVVVNELIDCGAIVNQKNEKGFTPLHFAAASTHGALCLELLVGNGADVNMKSKDGKTPLHMTALHGRFSRSQTIIQSGAVIDCEDKNGNTPLHIAARYGHELLINTLITSGADTAKRGIHGMFPLHLAALSGFSDCCRKLLSSGFDIDTPDDFGRTCLHAAAAGGNLECLNLLLNTGADFNKKDKFGRSPLHYAAANCNYQCLFALVGSGASVNDLDERGCTPLHYAATSDTDGKCLEYLLRNDANPGIRDKQGYNAVHYSAAYGHRLCLQLIASETPLDVLMETSGTDMLSDSDNRATISPLHLAAYHGHHQALEVLVQSLLDLDVRNSSGRTPLDLAAFKGHVECVDVLINQGASILVKDYILKRTPIHAAATNGHSECLRLLIGNAEPQNAVDIQDGNGQTPLMLSVLNGHTDCVYSLLNKGANVDAKDKWGRTALHRGAVTGHEECVDALLQHGAKCLLRDSRGRTPIHLSAACGHIGVLGALLQSAASMDANPATADNHGYTALHWACYNELLSMQPPSQTM

SEQ ID NO: 5211 - protein, 1053 aa, Homo sapiens; identical to SEQ ID NO: 5208
  Payload ID: 1129;
  Gene Symbol: ANKRD28;
  Gene Name: ankyrin repeat domain 28;
  Uniprot ID:  O15084;
  ENSP ID: ENSP00000397341

SEQ ID NO: 5212 - protein, 899 aa, Homo sapiens; identical to SEQ ID NO: 5207
  Payload ID: 1129;
  Gene Symbol: ANKRD28;
  Gene Name: ankyrin repeat domain 28;
  Uniprot ID:  O15084;
  ENSP ID: ENSP00000485421

SEQ ID NO: 5213 - protein, 268 aa, Homo sapiens
  Payload ID: 1130;
  Gene Symbol: ANKRD29;
  Gene Name: ankyrin repeat domain 29;
  Uniprot ID:  Q8N6D5;
  ENSP ID: ENSP00000323387
MCRMSFKKETPLANAAFWAARRGNLALLKLLLNSGRVDVDCRDSHGTTLLMVAAYAGHIDCVRELVLQGADINLQRESGTTALFFAAQQGHNDVVRFLFGFGASTEFRTKDGGTALLAASQYGHMQVVETLLKHGANIHDQLYDGATALFLAAQGGYLDVIRLLLASGAKVNQPRQDGTAPLWIASQMGHSEVVRVMLLRGADRDAARNDGTTALLKAANKGYNDVIKELLKFSPTLGILKANELPAELTKNERILRLLRSKEGPRKS

SEQ ID NO: 5214 - protein, 143 aa, Homo sapiens
  Payload ID: 1130;
  Gene Symbol: ANKRD29;
  Gene Name: ankyrin repeat domain 29;
  ENSP ID: ENSP00000465936
MCRMSFKKETPLANAAFWAARRGNLALLKLLLNSGRVDVDCRDSHGTTLLMVAAYAGHIDCVRELVLQGADINLQREDGGTALLAASQYGHMQVVETLLKHGANIHDQLYDGATALFLAAQGGYLDVIRLLLASGAKVNQPRQ

SEQ ID NO: 5215 - protein, 126 aa, Homo sapiens
  Payload ID: 1130;
  Gene Symbol: ANKRD29;
  Gene Name: ankyrin repeat domain 29;
  ENSP ID: ENSP00000467890
  MOD_RES (1)..(1): Any amino acid
XGGYLDVIRLLLASGAKVNQPRQDGTAPLWIASQMGHSEVVRVMLLRGADRDAARNDGTTALLKAANKGYNDVIKELLKFSPTLGILKNGTSALHAAVLSGNIKTVALLLEAGADPSLRNKVRWQN

SEQ ID NO: 5216 - protein, 301 aa, Homo sapiens
  Payload ID: 1130;
  Gene Symbol: ANKRD29;
  Gene Name: ankyrin repeat domain 29;
  Uniprot ID:  Q8N6D5;
  ENSP ID: ENSP00000468354
MCRMSFKKETPLANAAFWAARRGNLALLKLLLNSGRVDVDCRDSHGTTLLMVAAYAGHIDCVRELVLQGADINLQRESGTTALFFAAQQGHNDVVRFLFGFGASTEFRTKDGGTALLAASQYGHMQVVETLLKHGANIHDQLYDGATALFLAAQGGYLDVIRLLLASGAKVNQPRQDGTAPLWIASQMGHSEVVRVMLLRGADRDAARNDGTTALLKAANKGYNDVIKELLKFSPTLGILKNGTSALHAAVLSGNIKTVALLLEAGADPSLRNKANELPAELTKNERILRLLRSKEGPRKS

SEQ ID NO: 5217 - protein, 110 aa, Homo sapiens
  Payload ID: 1130;
  Gene Symbol: ANKRD29;
  Gene Name: ankyrin repeat domain 29;
  ENSP ID: ENSP00000477066
MCRMSFKKETPLANAAFWAARRGNLALLKLLLNSGRVDVDCRDSVRWFGRCMPSMHHCPLWAQEHLRNTFPFTMLIYFFMCLLALSFLKHPRYCGELKNMLGEVRKKRKQ

SEQ ID NO: 5218 - protein, 1341 aa, Homo sapiens
  Payload ID: 1131;
  Gene Symbol: ANKRD30A;
  Gene Name: ankyrin repeat domain 30A;
  ENSP ID: ENSP00000354432
MTKRKKTINLNIQDAQKRTALHWACVNGHEEVVTFLVDRKCQLDVLDGEHRTPLMKALQCHQEACANILIDSGADINLVDVYGNTALHYAVYSEILSVVAKLLSHGAVIEVHNKASLTPLLLSITKRSEQIVEFLLIKNANANAVNKYKCTALMLAVCHGSSEIVGMLLQQNVDVFAADICGVTAEHYAVTCGFHHIHEQIMEYIRKLSKNHQNTNPEGTSAGTPDEAAPLAERTPDTAESLVEKTPDEAAPLVERTPDTAESLVEKTPDEAASLVEGTSDKIQCLEKATSGKFEQSAEETPREITSPAKETSEKFTWPAKGRPRKIAWEKKEDTPREIMSPAKETSEKFTWAAKGRPRKIAWEKKETPVKTGCVARVTSNKTKVLEKGRSKMIACPTKESSTKASANDQRFPSESKQEEDEEYSCDSRSLFESSAKIQVCIPESIYQKVMEINREVEEPPKKPSAFKPAIEMQNSVPNKAFELKNEQTLRADPMFPPESKQKDYEENSWDSESLCETVSQKDVCLPKATHQKEIDKINGKLEESPNKDGLLKATCGMKVSIPTKALELKDMQTFKAEPPGKPSAFEPATEMQKSVPNKALELKNEQTLRADEILPSESKQKDYEENSWDTESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKATHQKEIDKINGKLEESPDNDGFLKAPCRMKVSIPTKALELMDMQTFKAEPPEKPSAFEPAIEMQKSVPNKALELKNEQTLRADQMFPSESKQKKVEENSWDSESLRETVSQKDVCVPKATHQKEMDKISGKLEDSTSLSKILDTVHSCERARELQKDHCEQRTGKMEQMKKKFCVLKKKLSEAKEIKSQLENQKVKWEQELCSVRLTLNQEEEKRRNADILNEKIREELGRIEEQHRKELEVKQQLEQALRIQDIELKSVESNLNQVSHTHENENYLLHENCMLKKEIAMLKLEIATLKHQYQEKENKYFEDIKILKEKNAELQMTLKLKEESLTKRASQYSGQLKVLIAENTMLTSKLKEKQDKEILEAEIESHHPRLASAVQDHDQIVTSRKSQEPAFHIAGDACLQRKMNVDVSSTIYNNEVLHQPLSEAQRKSKSLKINLNYAGDALRENTLVSEHAQRDQRETQCQMKEAEHMYQNEQDNVNKHTEQQESLDQKLFQLQSKNMWLQQQLVHAHKKADNKSKITIDIHFLERKMQHHLLKEKNEEIFNYNNHLKNRIYQYEKEKAETENS

SEQ ID NO: 5219 - protein, 1460 aa, Homo sapiens
  Payload ID: 1131;
  Gene Symbol: ANKRD30A;
  Gene Name: ankyrin repeat domain 30A;
  ENSP ID: ENSP00000363792
MTKRKKTINLNIQDAQKRTALHWACVNGHEEVVTFLVDRKCQLDVLDGEHRTPLMKALQCHQEACANILIDSGADINLVDVYGNTALHYAVYSEILSVVAKLLSHGAVIEVHNKASLTPLLLSITKRSEQIVEFLLIKNANANAVNKYKCTALMLAVCHGSSEIVGMLLQQNVDVFAADICGVTAEHYAVTCGFHHIHEQIMEYIRKLSKNHQNTNPEGTSAGTPDEAAPLAERTPDTAESLVEKTPDEAAPLVERTPDTAESLVEKTPDEAASLVEGTSDKIQCLEKATSGKFEQSAEETPREITSPAKETSEKFTWPAKGRPRKIAWEKKEDTPREIMSPAKETSEKFTWAAKGRPRKIAWEKKETPVKTGCVARVTSNKTKVLEKGRSKMIACPTKESSTKASANDQRFPSESKQEEDEEYSCDSRSLFESSAKIQVCIPESIYQKVMEINREVEEPPKKPSAFKPAIEMQNSVPNKAFELKNEQTLRADPMFPPESKQKDYEENSWDSESLCETVSQKDVCLPKATHQKEIDKINGKLEESPNKDGLLKATCGMKVSIPTKALELKDMQTFKAEPPGKPSAFEPATEMQKSVPNKALELKNEQTLRADEILPSESKQKDYEENSWDTESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKATHQKEIDKINGKLEESPDNDGFLKAPCRMKVSIPTKALELMDMQTFKAEPPEKPSAFEPAIEMQKSVPNKALELKNEQTLRADQMFPSESKQKKVEENSWDSESLRETVSQKDVCVPKATHQKEMDKISGKLEDSTSLSKILDTVHSCERARELQKDHCEQRTGKMEQMKKKFCVLKKKLSEAKEIKSQLENQKVKWEQELCSVRLTLNQEEEKRRNADILNEKIREELGRIEEQHRKELEVKQQLEQALRIQDIELKSVESNLNQVSHTHENENYLLHENCMLKKEIAMLKLEIATLKHQYQEKENKYFEDIKILKEKNAELQMTLKLKEESLTKRASQYSGQLKVLIAENTMLTSKLKEKQDKEILEAEIESHHPRLASAVQDHDQIVTSRKSQEPAFHIAGDACLQRKMNVDVSSTIYNNEVLHQPLSEAQRKSKSLKINLNYAGDALRENTLVSEHAQRDQRETQCQMKEAEHMYQNEQDNVNKHTEQQESLDQKLFQLQSKNMWLQQQLVHAHKKADNKSKITIDIHFLERKMQHHLLKEKNEEIFNYNNHLKNRIYQYEKEKAETENS

SEQ ID NO: 5220 - protein, 1341 aa, Homo sapiens; identical to SEQ ID NO: 5218
  Payload ID: 1131;
  Gene Symbol: ANKRD30A;
  Gene Name: ankyrin repeat domain 30A;
  ENSP ID: ENSP00000473551

SEQ ID NO: 5221 - protein, 1397 aa, Homo sapiens
  Payload ID: 1131;
  Gene Symbol: ANKRD30A;
  Gene Name: ankyrin repeat domain 30A;
  Uniprot ID:  Q9BXX3;
  ENSP ID: ENSP00000477963
MEEISAAAVKVVPGPERPSPFSQLVYTSNDSYIVHSGDLRKIHKAASRGQVRKLEKMTKRKKTINLNIQDAQKRTALHWACVNGHEEVVTFLVDRKCQLDVLDGEHRTPLMKALQCHQEACANILIDSGADINLVDVYGNTALHYAVYSEILSVVAKLLSHGAVIEVHNKASLTPLLLSITKRSEQIVEFLLIKNANANAVNKYKCTALMLAVCHGSSEIVGMLLQQNVDVFAADICGVTAEHYAVTCGFHHIHEQIMEYIRKLSKNHQNTNPEGTSAGTPDEAAPLAERTPDTAESLVEKTPDEAAPLVERTPDTAESLVEKTPDEAASLVEGTSDKIQCLEKATSGKFEQSAEETPREITSPAKETSEKFTWPAKGRPRKIAWEKKEDTPREIMSPAKETSEKFTWAAKGRPRKIAWEKKETPVKTGCVARVTSNKTKVLEKGRSKMIACPTKESSTKASANDQRFPSESKQEEDEEYSCDSRSLFESSAKIQVCIPESIYQKVMEINREVEEPPKKPSAFKPAIEMQNSVPNKAFELKNEQTLRADPMFPPESKQKDYEENSWDSESLCETVSQKDVCLPKATHQKEIDKINGKLEESPNKDGLLKATCGMKVSIPTKALELKDMQTFKAEPPGKPSAFEPATEMQKSVPNKALELKNEQTLRADEILPSESKQKDYEENSWDTESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKATHQKEIDKINGKLEESPDNDGFLKAPCRMKVSIPTKALELMDMQTFKAEPPEKPSAFEPAIEMQKSVPNKALELKNEQTLRADQMFPSESKQKKVEENSWDSESLRETVSQKDVCVPKATHQKEMDKISGKLEDSTSLSKILDTVHSCERARELQKDHCEQRTGKMEQMKKKFCVLKKKLSEAKEIKSQLENQKVKWEQELCSVRLTLNQEEEKRRNADILNEKIREELGRIEEQHRKELEVKQQLEQALRIQDIELKSVESNLNQVSHTHENENYLLHENCMLKKEIAMLKLEIATLKHQYQEKENKYFEDIKILKEKNAELQMTLKLKEESLTKRASQYSGQLKVLIAENTMLTSKLKEKQDKEILEAEIESHHPRLASAVQDHDQIVTSRKSQEPAFHIAGDACLQRKMNVDVSSTIYNNEVLHQPLSEAQRKSKSLKINLNYAGDALRENTLVSEHAQRDQRETQCQMKEAEHMYQNEQDNVNKHTEQQESLDQKLFQLQSKNMWLQQQLVHAHKKADNKSKITIDIHFLERKMQHHLLKEKNEEIFNYNNHLKNRIYQYEKEKAETENS

SEQ ID NO: 5222 - protein, 1392 aa, Homo sapiens
  Payload ID: 1132;
  Gene Symbol: ANKRD30B;
  Gene Name: ankyrin repeat domain 30B;
  Uniprot ID:  Q9BXX2;
  ENSP ID: ENSP00000351875
MKRLLAAAGKGVRGPEPPNPFSERVYTEKDYGTIYFGDLGKIHTAASRGQVQKLEKMTVGKKPVNLNKRDMKKRTALHWACVNGHAEVVTFLVDRKCQLNVLDGEGRTPLMKALQCEREACANILIDAGADLNYVDVYGNTALHYAVYSENLLMVATLLSYGAVIEVQNKASLTPLLLAIQKRSKQTVEFLLTKNANANAFNESKCTALMLAICEGSSEIVGMLLQQNVDVFAEDIHGITAERYAAACGVNYIHQQLLEHIRKLPKNPQNTNPEGTSTGTPDEAAPLAERTPDTAESLLEKTPDEAARLVEGTSAKIQCLGKATSGKFEQSTEETPRKILRPTKETSEKFSWPAKERSRKITWEEKETSVKTECVAGVTPNKTEVLEKGTSNMIACPTKETSTKASTNVDVSSVEPIFSLFGTRTIENSQCTKVEEDFNLATKIISKSAAQNYTCLPDATYQKDIKTINHKIEDQMFPSESKREEDEEYSWDSGSLFESSAKTQVCIPESMYQKVMEINREVEELPEKPSAFKPAVEMQKTVPNKAFELKNEQTLRAAQMFPSESKQKDDEENSWDSESPCETVSQKDVYLPKATHQKEFDTLSGKLEESPVKDGLLKPTCGRKVSLPNKALELKDRETFKAESPDKDGLLKPTCGRKVSLPNKALELKDRETLKAESPDNDGLLKPTCGRKVSLPNKALELKDRETFKAAQMFPSESKQKDDEENSWDFESFLETLLQNDVCLPKATHQKEFDTLSGKLEESPDKDGLLKPTCGMKISLPNKALELKDRETFKAEDVSSVESTFSLFGKPTTENSQSTKVEEDFNLTTKEGATKTVTGQQERDIGIIERAPQDQTNKMPTSELGRKEDTKSTSDSEIISVSDTQNYECLPEATYQKEIKTTNGKIEESPEKPSHFEPATEMQNSVPNKGLEWKNKQTLRADSTTLSKILDALPSCERGRELKKDNCEQITAKMEQTKNKFCVLQKELSEAKEIKSQLENQKAKWEQELCSVRLTLNQEEEKRRNVDILKEKIRPEEQLRKKLEVKQQLEQTLRIQDIELKSVTSNLNQVSHTHESENDLFHENCMLKKEIAMLKLEVATLKHQHQVKENKYFEDIKILQEKNAELQMTLKLKQKTVTKRASQYREQLKVLTAENTMLTSKLKEKQDKEILETEIESHHPRLASALQDHDQSVTSRKNQELAFHSAGDAPLQGIMNVDVSNTIYNNEVLHQPLYEAQRKSKSPKINLNYAGDDLRENALVSEHAQRDRCETQCQMKKAEHMYQNEQDNVDKHTEQQESLEQKLFQLESKNRWLRQQLVYAHKKVNKSKVTINIQFPEMKMQRHLNEKNEEVFNYGNHLKERIDQYEKEKAEREVSIKKYKYFSNFLKESGLG

SEQ ID NO: 5223 - protein, 619 aa, Homo sapiens
  Payload ID: 1132;
  Gene Symbol: ANKRD30B;
  Gene Name: ankyrin repeat domain 30B;
  Uniprot ID:  Q9BXX2;
  ENSP ID: ENSP00000463332
MKRLLAAAGKGVRGPEPPNPFSERVYTEKDYGTIYFGDLGKIHTAASRGQVQKLEKMTVGKKPVNLNKRDMKKRTALHWACVNGHAEVVTFLVDRKCQLNVLDGEGRTPLMKALQCEREACANILIDAGADLNYVDVYGNTALHYAVYSENLLMVATLLSYGAVIEVQNKASLTPLLLAIQKRSKQTVEFLLTKNANANAFNESKCTALMLAICEGSSEIVGMLLQQNVDVFAEDIHGITAERYAAACGVNYIHQQLLEHIRKLPKNPQNTNPEGTSTGTPDEAAPLAERTPDTAESLLEKTPDEAARLVEGTSAKIQCLGKATSGKFEQSTEETPRKILRPTKETSEKFSWPAKERSRKITWEEKETSVKTECVAGVTPNKTEVLEKGTSNMIACPTKETSTKASTNVDVSSVEPIFSLFGTRTIENSQCTKVEEDFNLATKIISKSAAQNYTCLPDATYQKDIKTINHKIEDQMFPSESKREEDEEYSWDSGSLFESSAKTQVCIPESMYQKVMEINREVEELPEKPSAFKPAVEMQKTVPNKAFELKNEQTLRAAQMFPSESKQKDDEENSWDSESPCETVSQKDVYLPKATHQKEFDTLSGKLEAYLWKESFSSK

SEQ ID NO: 5224 - protein, 251 aa, Homo sapiens
  Payload ID: 1133;
  Gene Symbol: ANKRD30BL;
  Gene Name: ankyrin repeat domain 30B-like;
  Uniprot ID:  A7E2S9;
  ENSP ID: ENSP00000295181
MERLSAAPVKGQTGPERPSPFSQLVYTNNDSYVIHHGDLRKIHKAASRGQAWKLERMMKKTTMDLNIRDAKKRTALYWACANGHAEVVTLLVDRKCQLDVLDGENRTILMKALQCQREACANILIDSGADPNIVDVYGNTAVHYAVNSENLSVVAKLLSCGADIEVKNKAGHTPLLLAIRKRSEEIVEFLLTKNANANAVDKFKCTALMLAICHGSSEIVGKLLQQNVDICAEATCGMIAERYAVACGFNL

SEQ ID NO: 5225 - protein, 258 aa, Homo sapiens
  Payload ID: 1133;
  Gene Symbol: ANKRD30BL;
  Gene Name: ankyrin repeat domain 30B-like;
  Uniprot ID:  A7E2S9;
  ENSP ID: ENSP00000386398
MERLSAAPVKGQTGPERPSPFSQLVYTNNDSYVIHHGDLRKIHKAASRGQAWKLERMMKKTTMDLNIRDAKKRTALYWACANGHAEVVTLLVDRKCQLDVLDGENRTILMKALQCQREACANILIDSGADPNIVDVYGNTAVHYAVNSENLSVVAKLLSCGADIEVKNKAGHTPLLLAIRKRSEEIVEFLLTKNANANAVDKFKCVHQQLLEYKQKISKNSQNSNPEGTSEGTPDEAAPLAERTPDTAESLVERTPDE

SEQ ID NO: 5226 - protein, 1873 aa, Homo sapiens
  Payload ID: 1134;
  Gene Symbol: ANKRD31;
  Gene Name: ankyrin repeat domain 31;
  Uniprot ID:  Q8N7Z5;
  ENSP ID: ENSP00000274361
MEEGVQAPDWDSDETVIEGSVTESDLEEKELPWRRLLFDQDASLKSEFSLHPDTRGMCKGMPSPEIQLGFKLREDLQEQMNKNKMMPVLSEDTILQSQDETERNQALLQTRKNCSMFIGSFRQSGLSLNHQNIEGPEAESPEVLPHIEKELSEGRDSPEVSLLSGTAITVSDTVAVKETSLVEPEKILAAPNTFFEPRKEVTMTMTSEETKDEESSLETFVSALESLLTSPESTQEERLFELVSDFDRKELMNPLSDSLSSISIPLNSWSACHRDLLEDAKDDALPAELLEALNTLSEAKVETICHRKEGGSSLIARNECLEVEFNTSQTNEDCTQIAETLQDPNPSGLQTLAHQNITSCEPLSNKRNSNSVTNSSDQETACVLRRSSRLEKLKVSRDAKYSDHMYKMPEKILPKILGCEDLTNNNSSAQNFRMQDPALMIDGKEKNMHSARFKNGKQIRKNEQFSGKKEKMKVNKISLHSINRRNIFGENLVYKAALHDDADLVHHCIKKGGNVNQPSYAGWTALHEASVGGFYRTASELLKGGADVNIKGLYQITPLHDAVMNGHYKVAELLLLNGADPLFRNDDGKCALDEAKDLCMKRLLERYIPKHQKCLTSAQRSSIDPLDIEDVYQHKKPKFSSKSHIWHVYNENSNRQKLEHVKVNKGSKASLFINKEDVYEYYQKDPKNTKFGKSKHKQSTLDQIYSTGLRKGNLHNVKDPNTNVPKGIGRRKTQHKRTQVDDVDCNPRKILAVSPSRRINRLVTYQQHIPETHNDLPEELCEPSSLTLSSLRNGLDSSTEACSVSKEKHIQNLDLSDSQEVQCLELESVDQTEAVSFPGLLLHKEIKLPVVTTDKQPHTLQEQHHVLYKSHENSNLVPKDERFNKWENSFLSFVKENSDNDDDDDCSTSEKAITSKKVLCSTGGKKHYNFKENLTNKKEMGFQQFLLSEDHLSQENELKAVSLTTLPEQEAVNFSYSDNAVISEHVANYEQCIFGPSFDHSNGNPEQNSLACMRTLLTHEASKLTNHVELFKKPQDYIPRAPTFLMNQTDTHIVEKMAKNCDTERNYIDRDQKIIYSNEPLSIVAHSQVIETTKVEKRRQNHLESETIHNIDSHSTDNMSKELANISKLSQREKKEISHKPGMKAGRINKRNARGESQLHLAVRRGNLPLVKALIESGADVNLNDNAGWTPLHEASNEGSIDIIVELLKAGAKVNCENIDGILPLHDAVANNHLKAAEILLQNGANPNQKDQKQKSALDEADDEKMKELLRSYGAIETVNRDESDAIVNEKIPAVRSKRHKQCFCDDGKTIDSSSLSHQERSRESLSVHQTLSAILQDIEEKQEYLLEFEIRNPEDAEQYIEKMLKIKKIMDNVLAKQKAERDDLAKKYRVSIESFKHGALREQLANLAARQKSLLVVAKKQKKISLKIQNCRNVTSLPCLSLRKLPPRSEISSEKDSQELTSLENLEHPQSGSLSPVSGSMQETQLSLETWNYSQNTNICLNSEAVRRGEFSGNDMNSKQNGSDCTLDGFPKSRHSDGTEKNKLPSQPVAFIGQTEYSQKENDLTEATDKDHEFYVSSPVIGKLNISETASVLAENAAHPSNIICDQDLSNYDPKRGNRKTSSQQSPTGASESLAHQGIAVLGSDTVHQMKPYLKKSVSVVPCADDSQISSSSGSGQQDTIKKALNYSTAPKKKCIQIKDLILLGRINPGNNILEFKTQETTHKASILLNGKLKVESGQIYKNPVTWLKDLLGGNSYVTWNYAWSKVTYLGKELLRYVSEDAPILPEPNSVPQQYQPCLPEVACLDDPVQEPNKSMFEKTKFGQGTSRESMQSSPRYLQINEILLISDQEFLPCHIMDQHWKFCVECEELTP

SEQ ID NO: 5227 - protein, 1930 aa, Homo sapiens
  Payload ID: 1134;
  Gene Symbol: ANKRD31;
  Gene Name: ankyrin repeat domain 31;
  ENSP ID: ENSP00000427262
MEEGVQAPDWDSDETVIEGSVTESDLEEKELPWRRLLFDQDASLKSEFSLHPDTRGMCKGMPSPEIQLGFKLREDLQEQMNKNKMMPVLSEDTILQSQDETERNQALLQTRKNCSMFIGSFRQSGLSLNHQNIEGPEAESPEVLPHIEKELSEGRDSPEVSLLSGTAITVSDTVAVKETSLVEPEKILAAPNTFFEPRKEVTMTMTSEETKDEESSLETFVSALESLLTSPESTQEERLFELVSDFDRKELMNPLSDSLSSISIPLNSWSACHRDLLEDAKDDALPAELLEALNTLSEAKVETICHRKEGGSSLIARNECLEVEFNTSQTNEDCTQIAETLQDPNPSGLQTLAHQNITSCEPLSNKRNSNSVTNSSDQETACVLRRSSRLEKLKVSRDAKYSDHMYKMPEKILPKILGCEDLTNNNSSAQNFRMQDPALMIDGKEKNMHSARFKNGKQIRKNEQFSGKKEKMKVNKISLHSINRRNIFGENLVYKAALHDDADLVHHCIKKGGNVNQPSYAGWTALHEASVGGFYRTASELLKGGADVNIKGLYQITPLHDAVMNGHYKVAELLLLNGADPLFRNDDGKCALDEAKDLCMKRLLERYIPKHQKCLTSAQRSSIDPLDIEDVYQHKKPKFSSKSHIWHVYNENSNRQKLEHVKVNKGSKASLFINKEDVYEYYQKDPKNTKFGKSKHKQSTLDQIYSTGLRKGNLHNVKDPNTNVPKGIGRRKTQHKRTQVDDVDCNPRKILAVSPSRRINRLVTYQQHIPETHNDLPEELCEPSSLTLSSLRNGLDSSTEACSVSKEKHIQNLDLSDSQEVQCLELESVDQTEAVSFPGLLLHKEIKLPVVTTDKQPHTLQEQHHVLYKSHENSNLVPKDERFNKWENSFLSFVKENSDNDDDDDCSTSEKAITSKKVLCSTGGKKHYNFKENLTNKKEMGFQQFLLSEDHLSQENELKAVSLTTLPEQEAVNFSYSDNAVISEHVANYEQCIFGPSFDHSNGNPEQNSLACMRTLLTHEASKLTNHVELFKKPQDYIPRAPTFLMNQTDTHIVEKMAKNCDTERNYIDRDQKIIYSNEPLSIVAHSQVIETTKVEKRRQNHLESETIHNIDSHSTDNMSKELANISKLSQREKKEISHKPDEELTNNISGDEITIRNCEEIKEKTESEIHMPTNSQEHKTVQNFRKRQSFLKTTCNLGMKAGRINKRNARGESQLHLAVRRGNLPLVKALIESGADVNLNDNAGWTPLHEASNEGSIDIIVELLKAGAKVNCENIDGILPLHDAVANNHLKAAEILLQNGANPNQKDQKQKSALDEADDEKMKELLRSYGAIETVNRDESDAIVNEKIPAVRSKRHKQCFCDDGKTIDSSSLSHQERSRESLSVHQTLSAILQDIEEKQEYLLEFEIRNPEDAEQYIEKMLKIKKIMDNVLAKQKAERDDLAKKYRVSIESFKHGALREQLANLAARQKSLLVVAKKQKKISLKIQNCRNVTSLPCLSLRKLPPRSEISSEKDSQELTSLENLEHPQSGSLSPVSGSMQETQLSLETWNYSQNTNICLNSEAVRRGEFSGNDMNSKQNGSDCTLDGFPKSRHSDGTEKNKLPSQPVAFIGQTEYSQKENDLTEATDKDHEFYVSSPVIGKLNISETASVLAENAAHPSNIICDQDLSNYDPKRGNRKTSSQQSPTGASESLAHQGIAVLGSDTVHQMKPYLKKSVSVVPCADDSQISSSSGSGQQDTIKKALNYSTAPKKKCIQIKDLILLGRINPGNNILEFKTQETTHKASILLNGKLKVESGQIYKNPVTWLKDLLGGNSYVTWNYAWSKVTYLGKELLRYVSEDAPILPEPNSVPQQYQPCLPEVACLDDPVQEPNKSMFEKTKFGQGTSRESMQSSPRYLQINEILLISDQEFLPCHIMDQHWKFCVECEELTP

SEQ ID NO: 5228 - protein, 452 aa, Homo sapiens
  Payload ID: 1135;
  Gene Symbol: ANKRD33;
  Gene Name: ankyrin repeat domain 33;
  Uniprot ID:  Q7Z3H0;
  ENSP ID: ENSP00000301190
MKVQPSVTCVASWGGIVHLEAFGDPVIVLRGAWAVPRVDCLIDTLRTPNASCMRKGTHLLVPCLEEEELALHRRRLDMSEALPCPGKETPTPGCRLGALYWACVHNDPTQLQAILDGGVSPEEATQVDSNGRTGLMVACYHGFQSVVALLSHCPFLDVNQQDKGGDTALMLAAQAGHVPLVSLLLNYYVGLDLERRDQRGLTALMKAAMRNRCADLTAVDPVRGKTALEWAVLTDSFDTVWRIRQLLRRPQVEQLSQHYKPEWPALSGLVAQAQAQAQVAPSLLERLQATLSLPFAPSPQEGGVLDHLVTATTSLASPFVTTACHTLCPDHPPSLGTRSKSVPELLGTAPPPPLVPQSPPGSPQRSPWVFVPYQSPQGILSKCLQWLQPRDSTSPRPQVPKILLSKASSSSHQCQPKPSPSGHQSLALPLWRYQELRIEKRKQEEEARMAQK

SEQ ID NO: 5229 - protein, 272 aa, Homo sapiens
  Payload ID: 1135;
  Gene Symbol: ANKRD33;
  Gene Name: ankyrin repeat domain 33;
  Uniprot ID:  Q7Z3H0;
  ENSP ID: ENSP00000344690
MVACYHGFQSVVALLSHCPFLDVNQQDKGGDTALMLAAQAGHVPLVSLLLNYYVGLDLERRDQRGLTALMKAAMRNRCECVATLLMAGADLTAVDPVRGKTALEWAVLTDSFDTVWRIRQLLRRPQVEQLSQHYKPEWPALSGLVAQAQAQAQVAPSLLERLQATLSLPFAPSPQEGGVLDHLVTATTSLASPFVTTACHTLCPDHPPSLGTRSKSVPELLVPAEAQSFRTPKSGPSSLAIPGAQDREEETGGGGQNGTEVGEDGIGQAGNR

SEQ ID NO: 5230 - protein, 136 aa, Homo sapiens
  Payload ID: 1135;
  Gene Symbol: ANKRD33;
  Gene Name: ankyrin repeat domain 33;
  ENSP ID: ENSP00000448116
MKVQPSVTCVASWGGIVHLEAFGDPVIVLRGAWAVPRVDCLIDTLRTPNASCMRKGTHLLVPCLEEEELALHRRRLDMSEALPCPGKETPTPGCRLGALYWACVHNDPTQLQAILDGGVSPEEATQVDSNGRATCL

SEQ ID NO: 5231 - protein, 494 aa, Homo sapiens
  Payload ID: 1136;
  Gene Symbol: ANKRD33B;
  Gene Name: ankyrin repeat domain 33B;
  Uniprot ID:  A6NCL7;
  ENSP ID: ENSP00000296657
MVLLAGTGPEGGGARCMTPPPPSPPRGAQVEEDPADYEEFEDFSSLPDTRSIASDDSFYPFEDEEEHGVESAESVPEGVPESVPETATLLRAACANNVGLLRTLVRRGVSVEEAQETDRNGRTGLIVACYHGFVDTVVALAECPHVDVNWQDSEGNTALITAAQAGHAIITNYLLNYFPGLDLERRNAFGFTALMKAAMQGRTDCIRALMLAGADVHARDPRRGMSPQEWATYTGRVDAVRLMQRLLERPCPEQFWEKYRPELPPPPEAARKPAGSKNCLQRLTDCVLSVLTPRSVRGPEDGGVLDHMVRMTTSLYSPAVAIVCQTVCPESPPSVGKRRLAVQEILAARAARGPQAQEEDEVGGAGQRGRTGQEDADSREGSPRAGLPPALGSRGPAAPAPRKASLLPLQRLRRRSVRPGVVVPRVRVSKAPAPTFQPERPARKGSTKDSGHLQIPKWRYKEAKEEKRKAEEAEKKRQAEAQKERRTAPWKKRT

SEQ ID NO: 5232 - protein, 198 aa, Homo sapiens
  Payload ID: 1136;
  Gene Symbol: ANKRD33B;
  Gene Name: ankyrin repeat domain 33B;
  ENSP ID: ENSP00000422195
MVLLAGTGPEGGGARCMTPPPPSPPRGAQVEEDPADYEEFEDFSSLPDTRSIASDDSFYPFEDEEEHGVESAESVPEGVPESVPETATLLRAACANNVGLLRTLVRRGVSVEEAQETDRNGRTGLIVACYHGFVDTVVALAECPHVDVNWQDSEGNTALITAAQAGAAPVPMGIVSLDTGSQSCASGVSITWAGSCEH

SEQ ID NO: 5233 - protein, 496 aa, Homo sapiens
  Payload ID: 1137;
  Gene Symbol: ANKRD34A;
  Gene Name: ankyrin repeat domain 34A;
  Uniprot ID:  Q69YU3;
  ENSP ID: ENSP00000475189
MLHTEGHALLRAVGQGKLRLARLLLEGGAYVNEGDAQGETALMAACRARYDDPQNKARMVRYLLEQGADPNIADRLGRTALMHACAGGGGAAVASLLLAHGADPSVRDHAGASALVHALDRGDRETLATLLDACKAKGTEVIIITTDTSPSGTKKTRQYLNSPPSPGVEDPAPASPSPGFCTSPSEIQLQTAGGGGRGMLSPRAQEEEEKRDVFEFPLPKPPDDPSPSEPLPKPPRHPPKPLKRLNSEPWGLVAPPQPVPPTEGRPGIERLTAEFNGLTLTGRPRLSRRHSTEGPEDPPPWAEKVTSGGPLSRRNTAPEAQESGPPSGLRQKLSRMEPVELDTPGHLCPDSPESSRLSLERRRYSASPLTLPPAGSAPSPRQSQESLPGAVSPLSGRRRSPGLLERRGSGTLLLDHISQTRPGFLPPLNVSPHPPIPDIRPQPGGRAPSLPAPPYAGAPGSPRTKRKLVRRHSMQTEQIRLLGGFQSLGGPGEPGR

SEQ ID NO: 5234 - protein, 118 aa, Homo sapiens
  Payload ID: 1137;
  Gene Symbol: ANKRD34A;
  Gene Name: ankyrin repeat domain 34A;
  ENSP ID: ENSP00000478172
MLHTEGHALLRAVGQGKLRLARLLLEGGAYVNEGDAQGETALMAACRARYDDPQNKARMVRYLLEQGADPNIADRLGRTALMHACAGGGGAAVASLLLAHGADPSVRDHAGASALVHA

SEQ ID NO: 5235 - protein, 103 aa, Homo sapiens
  Payload ID: 1137;
  Gene Symbol: ANKRD34A;
  Gene Name: ankyrin repeat domain 34A;
  ENSP ID: ENSP00000484224
MLHTEGHALLRAVGQGKLRLARLLLEGGAYVNEGDAQGETALMAACRARYDDPQNKARMVRYLLEQGADPNIADRLGRTALMHACAGGGGAAVASLLLAHGAD

SEQ ID NO: 5236 - protein, 514 aa, Homo sapiens
  Payload ID: 1138;
  Gene Symbol: ANKRD34B;
  Gene Name: ankyrin repeat domain 34B;
  Uniprot ID:  A5PLL1;
  ENSP ID: ENSP00000339802
MDEGMEISSEGNSLIKAVHQSRLRLTRLLLEGGAYINESNDRGETPLMIACKTKHVDHQSVSKAKMVKYLLENNADPNIQDKSGKTALMHACLEKAGPEVVSLLLKSGADLSLQDHSSYSALVYAINSEDTETLKVLLSACKAKGKEVIIITTAKLPCGKHTTKQYLNMPPVDIDGCHSPATCTTPSEIDIKTASSPLSHSSETELTLFGFKDLELAGSNDDTWDPGSPVRKPALAPKGPKLPHAPPWVKSPPLLMHQNRVASLQEELQDITPEEELSYKTNGLALSKRFITRHQSIDVKDTAHLLRAFDQASSRKMSYDEINCQSYLSEGNQQCIEVPVDQDPDSNQTIFASTLRSIVQKRNLGANHYSSDSQLSAGLTPPTSEDGKALIGKKKILSPSPSQLSESKELLENIPPGPLSRRNHAVLERRGSGAFPLDHSVTQTRQGFLPPLNVNSHPPISDINVNNKICSLLSCGQKVLMPTVPIFPKEFKSKKMLLRRQSLQTEQIKQLVNF

SEQ ID NO: 5237 - protein, 17 aa, Homo sapiens
  Payload ID: 1138;
  Gene Symbol: ANKRD34B;
  Gene Name: ankyrin repeat domain 34B;
  ENSP ID: ENSP00000426198
MDEGMEISSEGNSLIKA

SEQ ID NO: 5238 - protein, 535 aa, Homo sapiens
  Payload ID: 1139;
  Gene Symbol: ANKRD34C;
  Gene Name: ankyrin repeat domain 34C;
  Uniprot ID:  P0C6C1;
  ENSP ID: ENSP00000401089
MMDDDTELRTDGNSLLKAVWLGRLRLTRLLLEGGAYINESNDKGETALMVACITKHVDQQSISKSKMVKYLLDNRADPNIQDKSGKTALIHACIRRAGGEVVSLLLENGADPSLEDRTGASALVYAINADDKDALKHLLDACKAKGKEVIIITTDKSSSGTKTTKQYLNVPPSPKVEDRHSPPLCASPSDIELKALGLDSPLTEKEDDFFSLQAGHPSSCNTSKAVNEPGSPTRKVSNLKRARLPQLKRLQSEPWGLIAPSVLAASTRQDETHGASTDNEVIKSISDISFPKRGPLSRTNSIDSKDPTLFHTVTEQVLKIPVSSAPASWKAAYEKGQAPHPRLARRGTLPVDQEKCGMGPSGPSALKEPASLKWLENDLYDLDIQPGPDPPNSISLESGKGPLDRKKLNSSHLSLFHGSRESLDTVPSTSPSSARRRPPHLLERRGSGTLLLDRISHTRPGFLPPLNVNLNPPIPDIRSSSKPSCSLASGLKSMVPVAPSSPKRVDLRSKKKLLRRHSMQIEQMKQLSDFEEIMT

SEQ ID NO: 5239 - protein, 1001 aa, Homo sapiens
  Payload ID: 1140;
  Gene Symbol: ANKRD35;
  Gene Name: ankyrin repeat domain 35;
  Uniprot ID:  Q8N283;
  ENSP ID: ENSP00000347802
MKRIFSCSSTQVAVERWNRHDQKLLEAVHRGDVGRVAALASRKSARPTKLDSNGQSPFHLAASKGLTECLTILLANGADINSKNEDGSTALHLATISCQPQCVKVLLQHGANEDAVDAENRSPLHWAASSGCASSVLLLCDHEAFLDVLDNDGRTPLMIASLGGHAAICSQLLQRGARVNVTDKNDKSALILACEKGSAEVAELLLSHGADAGAVDSTGHDALHYALHTQDKALWRHLQQALSRRRRGGQRLVQHPDLASQASPSEPQAGSPPKSSWRAEPEEEQEEKEDEDPCSEEWRWKYEEERRKVVRLEQELVQKTEECKTQAAAYLDLENQIREQAQELGVLLSWEPRASGKQGSSLRPGGDGMEQGCPKDLLAESTQELKKQQQAAATVNPVLAPKKAEDSAPGKIQYEVHGRSQPEEQGPPQSPASETIRKATGQQLTTNGAQTFGPDHADQLPAGQKESSQVLGVEPGGTVAEPVGPAAMNQLLLQLREELAAVWREKDAARGALSRPVMEGALGTPRAEAAAAAWEKMEARLERVLARLEWAKAGLQVKPEVPSQESREGALKAAPGSIKQDEEKEKRVPGAQGEPLGALGGEKALGGLAKGQLEKEMSVLRLSNSNLLEELGELGRERQRLQRELQSLSQRLQREFVPKPQAQVQLQQLRQSVGLLTNELAMEKEATEKLRKLLASQSSGLRGLWDCLPADLVGERSAQSKAAESLEELRACISTLVDRHREAQQVLARLQEENQQLRGSLSPCREPGTSLKAPASPQVAALEQDLGKLEEELRAVQATMSGKSQEIGKLKQLLYQATEEVAELRAREAASLRQHEKTRGSLVAQAQAWGQELKALLEKYNTACREVGRLREAVAEERRRSGDLAAQAAEQERQASEMRGRSEQFEKTAELLKEKMEHLIGACRDKEAKIKELLKKLEQLSEEVLAIRGENARLALQLQDSQKNHEEIISTYRNHLLNAARGYMEHEVYNILLQILSMEEE

SEQ ID NO: 5240 - protein, 911 aa, Homo sapiens
  Payload ID: 1140;
  Gene Symbol: ANKRD35;
  Gene Name: ankyrin repeat domain 35;
  ENSP ID: ENSP00000442671
MKRIFSCSSTQCVKVLLQHGANEDAVDAENRSPLHWAASSGCASSVLLLCDHEAFLDVLDNDGRTPLMIASLGGHAAICSQLLQRGARVNVTDKNDKSALILACEKGSAEVAELLLSHGADAGAVDSTGHDALHYALHTQDKALWRHLQQALSRRRRGGQRLVQHPDLASQASPSEPQAGSPPKSSWRAEPEEEQEEKEDEDPCSEEWRWKYEEERRKVVRLEQELVQKTEECKTQAAAYLDLENQIREQAQELGVLLSWEPRASGKQGSSLRPGGDGMEQGCPKDLLAESTQELKKQQQAAATVNPVLAPKKAEDSAPGKIQYEVHGRSQPEEQGPPQSPASETIRKATGQQLTTNGAQTFGPDHADQLPAGQKESSQVLGVEPGGTVAEPVGPAAMNQLLLQLREELAAVWREKDAARGALSRPVMEGALGTPRAEAAAAAWEKMEARLERVLARLEWAKAGLQVKPEVPSQESREGALKAAPGSIKQDEEKEKRVPGAQGEPLGALGGEKALGGLAKGQLEKEMSVLRLSNSNLLEELGELGRERQRLQRELQSLSQRLQREFVPKPQAQVQLQQLRQSVGLLTNELAMEKEATEKLRKLLASQSSGLRGLWDCLPADLVGERSAQSKAAESLEELRACISTLVDRHREAQQVLARLQEENQQLRGSLSPCREPGTSLKAPASPQVAALEQDLGKLEEELRAVQATMSGKSQEIGKLKQLLYQATEEVAELRAREAASLRQHEKTRGSLVAQAQAWGQELKALLEKYNTACREVGRLREAVAEERRRSGDLAAQAAEQERQASEMRGRSEQFEKTAELLKEKMEHLIGACRDKEAKIKELLKKLEQLSEEVLAIRGENARLALQLQDSQKNHEEIISTYRNHLLNAARGYMEHEVYNILLQILSMEEE

SEQ ID NO: 5241 - protein, 1941 aa, Homo sapiens
  Payload ID: 1141;
  Gene Symbol: ANKRD36;
  Gene Name: ankyrin repeat domain 36;
  Uniprot ID:  A6QL64;
  ENSP ID: ENSP00000391950
MEDGKRERWPTLMERLCSDGFAFPQYPIKPYHLKRIHRAVLHGNLEKLKYLLLTYYDANKRDRKERTALHLACATGQPEMVHLLVSRRCELNLCDREDRTPLIKAVQLRQEACATLLLQNGANPNITDFFGRTALHYAVYNEDTSMIEKLLSHGTNIEECSKCEYQPLLFAVSRRKVKMVEFLLKKKANVNAIDYLGRSALIHAVTLGEKDIVILLLQHNIDVLSRDAFRKIAGDYAIEAKNRVIFDLIYEYERKRYEDLPINSNPVSSQKQPALKATSGKEDSISNIATEIKDGQKSGTVSSQKQPALKDTSDKDDSVSNTATEIKDEQKSGTVLPAVEQCLNRSLYRPDAVAQPVTENEFSLESEIISKLYIPKRKIISPRSIKDVLPPVEEAVDRCLYLLDRFAQPVTKDKFALESENISEPYFTNRRTISQQSAENLDAACGIDKTENGNMFEDQNVDKEGKALPATGQKANVSPEQPPLFTHTVKDRDHISTRFLGGMDSLTSSEESSERPPLSTLTLKEADPSSKAAMRRKDSPPPGKVSSQKQPAEKATSDDKDSVSNIATEIKEGPISGTVSSQKQPAEKATSDEKDSVSNIATEIKKGQQSGTVSPQKQSAWKVIFKKKVSLLNIATRIMGGGKSGTVSSQKQPASKATSDKTDSALNIATEIKDGLQCGTVSSQKQPALKATTDEEDSVSNIATEIKDGEKSGTVSSQKQPALKATTDEEDSVSNIATEIKDGEKSGTVSSQKQPALKATTDEKDSVSNIATEIKDGEKSGTVSSQKPPALTATSDEEGSVLSIARENKDGEKSRTVSSRKKPALKATSDEKDSFSNITRGKKDGEISRKVSSQKPPTLKGTSDEEDSVLGIARENKDGEKSRTVSSEKPPGLKASSAEKDSVLNIARGKKDGEKTKRVSSRKKPSLEATSDEKDSFSNITREKKDGEISRKVSSQKPPALKGTSDEEDSVLGIARENKDGEKSRTVSSEKPPGLKATSDEKDSVLNIARGKKDGEKTRTVSSQKPPTLKATSDEEDSVLSIARENKDGEKSRTVSSEKPSGLKATSAEKDSVLNIARGKKYGEKTKRVSSRKKPALKATSDEKDSVLYIAREKKDGEKSRTVSSPKQPALKAICDKEDSVPNMATEKKDEQISGTVSCQKQPALKATSDKKDSVSNIPTEIKDGQQSGTVSSQKQPAWKATSVKKDSVSNIATEIKDGQIRGTGILEYTFNVMFDQIEEKFTSLNKSAGVSPQKQSAQKVIFKKKVSLLNIATRITGGWKSGTEYPENLPTLKATIENKNSVLNTATKMKDVQTSTPAEQDLEMASEGEQKRLEEYENNQPQVKNQIHSRDDLDDIIQSSQTVSEDGDSLCCNCKNVILLIDQHEMKCKDCVHLLKIKNTFCLWKRLIKLKDNHCEQLRVKIRKLKNKASVLQKRISEKEEIKSQLKHEILELEKELCSLRFAIQQEKKKRRNVEEVHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNGETLAKTIACYSGQLAALTDENTTLRSKLEKQRESRQRLETEMQSYHCRLNAARCDHDQSHSSKRDQELAFQGTVDKCRHLQENLNSHVLILSLQLSKAESKSRVLKTELHYTGEALKEKALVFEHVQSELKQKQSQMKDIEKMYKSGYNTMEKCIEKQERFCQLKKQNMLLQQQLDDARNKADNQEKAILNIQARCDARVQNLQAECRKHRLLLEEDNKMLVNELNHSKEKECQYEKEKAEREVAVRQLQQKRDDVLNKGSATKALLDASSRHCTYLENGMQDSRKKLDQMRSQFQEIQDQLTATIRCTKEMEGDTQKLEVEHVMMRKIIKKQDDQIERLEKILQHSSLMLQVFES

SEQ ID NO: 5242 - protein, 1941 aa, Homo sapiens; identical to SEQ ID NO: 5241
  Payload ID: 1141;
  Gene Symbol: ANKRD36;
  Gene Name: ankyrin repeat domain 36;
  Uniprot ID:  A6QL64;
  ENSP ID: ENSP00000419530

SEQ ID NO: 5243 - protein, 309 aa, Homo sapiens [sequence omitted]

SEQ ID NO: 5244 - protein, 1353 aa, Homo sapiens
  Payload ID: 1142;
  Gene Symbol: ANKRD36B;
  Gene Name: ankyrin repeat domain 36B;
  Uniprot ID:  Q8N2N9;
  ENSP ID: ENSP00000477778
MERLCSDGFAFPHYYIKPYHLKRIHRAVLRGNLEKLKYLLLTYYDANKRDRKERTALHLACATGQPEMVHLLVSRRCELNLCDREDRTPLIKAVQLRQEACATLLLQNGADPNITDVFGRTALHYAVYNEDTSMIEKLLSHGTNIEECSKNEYQPLLLAVSRRKVKMVEFLLKKKANVNAIDYLGRSALILAVTLGEKDIVILLLQHNIDVFSRDVYGKLAEDYASEAENRVIFDLIYEYKRKRYEDLPINSNPVSPQKQRAEKATSDDKDSVSNIATEIKEGPISGTVSSQKQPAEKATSDEKDSVSNIATEIKEGQQSGTVSPQKQSAQKVIFKKKVSLLNIATRIMGGGKSGTVSSQKQPASKTASDKTDSALNTATEIKDGLQCGTVSSQKQQALKATTDEEGSVSNIATEIKDGEKSGTVSSQKKPALKATSDEKDSFSNITREKKDGEISRTVSSQKPPALKATSVKEDSVLNIAREKKDGEKSRTVSFEQPPGLKATRDEKDSLLNIARGKKDGEKTRRVSSHKQPSLKATSDKEDSVPNMATETKDEQISGTVSCQKQPALKATSDKKDSVSNIPTEIKDGQQSGTVSSQKQPAWKATSVKKDSVSNIATEIKDGQIRGTVSSQRRPALKTTGDEKDSVSNIAREIKDGEKSGTVSPQKQSAQKVIFKKKVSLLNIATRITGGGKSGTEYPENLRTLKATIENKDSVLNTATKMKEVQTSTPAEQDLEMASEGEQKRLEEYENNQPQVKNQIHSRDDLDDIIQSSQTVSEDGDSLCCNCKNVILLIDQHEMKCKDCVHLLKIKNTFCLWKRLIKLKDNHCEQLRVKIRKLKNKASVLQKRISEKEEIKSQLKHEILELEKELCSLRFAIQQEKKKRRNVEELHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNGETLAKTIACYSGQLAALTDENTTLRSKLEKQRESRQRLETEMQSYRCRLNAARCDHDQSHSSKRDQELAFQGTVDKCRHLQENLNSHVLILSLQLSKAESKSRVLKTELHYTGEALKEKALVFEHVQSELKQKQSQMKDIEKMYKSGYNTMEKCIEKQERFCQLKKQNMLLQQQLDDARNKADNQEKAILNIQARCDARVQNLQAECRKHRLLLEEDNKMLVNELNHSKEKECQYEKEKAEREVAVRQLQQKRDDVLNKGSATKALLDASSRHCTYLENGMQDSRKKLDQMRSQFQEIQDQLTATIRCTKEMEGDTQKLEVEHVMMRKIIKKQDDQIERLEKILQHSSLMLQVFES

SEQ ID NO: 5245 - protein, 171 aa, Homo sapiens
  Payload ID: 1142;
  Gene Symbol: ANKRD36B;
  Gene Name: ankyrin repeat domain 36B;
  ENSP ID: ENSP00000480812
MERLCSDGFAFPHYYIKPYHLKRIHRAVLRGNLEKLKYLLLTYYDANKRDRKERTALHLACATGQPEMVHLLVSRRCELNLCDREDRTPLIKAVQLRQEACATLLLQNGADPNITDVFGRTALHYAVYNEDTSMIEKLLSHGTNIEECSKCLLRNNELRRLQVTTKILFQI

SEQ ID NO: 5246 - protein, 1353 aa, Homo sapiens; identical to SEQ ID NO: 5244
  Payload ID: 1142;
  Gene Symbol: ANKRD36B;
  Gene Name: ankyrin repeat domain 36B;
  Uniprot ID:  Q8N2N9;
  ENSP ID: ENSP00000481149

SEQ ID NO: 5247 - protein, 137 aa, Homo sapiens
  Payload ID: 1142;
  Gene Symbol: ANKRD36B;
  Gene Name: ankyrin repeat domain 36B;
  ENSP ID: ENSP00000481806
MLVNELNHSKEKECQYEKEKAEREVAVRQLQQKRDDVLNKGSATKALLDASSRHCTYLENGMQDSRKKLDQMRSQFQEIQDQLTATIRCTKEMEGDTQKLEVEHVMMRKIIKKQDDQIERLEKILQHSSLMLQVFES

SEQ ID NO: 5248 - protein, 239 aa, Homo sapiens
  Payload ID: 1142;
  Gene Symbol: ANKRD36B;
  Gene Name: ankyrin repeat domain 36B;
  Uniprot ID:  Q8N2N9;
  ENSP ID: ENSP00000482644
MERLCSDGFAFPHYYIKPYHLKRIHRAVLRGNLEKLKYLLLTYYDANKRDRKERTALHLACATGQPEMVHLLVSRRCELNLCDREDRTPLIKAVQLRQEACATLLLQNGADPNITDVFGRTALHYAVYNEDTSMIEKLLSHGTNIEECSKNEYQPLLLAVSRRKVKMVEFLLKKKANVNAIDYLGRSALILAVTLGEKDIVILLLQHNIDVFSRDVYGKLAEDYASEAENRVVSSETTS

SEQ ID NO: 5249 - protein, 1032 aa, Homo sapiens
  Payload ID: 1142;
  Gene Symbol: ANKRD36B;
  Gene Name: ankyrin repeat domain 36B;
  ENSP ID: ENSP00000484402
MGGGKSGTVSSQKQPASKTASDKTDSALNTATEIKDGLQCGTVSSQKQQALKATTDEEGSVSNIATEIKDGEKSGTVSSQKKPALKATSDEKDSFSNITREKKDGEISRTVSSQKPPALKATSVKEDSVLNIAREKKDGEKSRTVSFEQPPGLKATRDEKDSLLNIARGKKDGEKTRRVRVDKKFSSLNKSAGGSLKLHILIQHKGGRRKRGMSSHKQPSLKATSDKEDSVPNMATETKDEQISGTVSCQKQPALKATSDKKDSVSNIPTEIKDGQQSGTVSSQKQPAWKATSVKKDSVSNIATEIKDGQIRGTGILEYTFNVMFDQIEEKFTSPNKSAGGVSPQKQSAQKVIFKKKVSLLNIATRITGGGKSGTEYPENLRTLKATIENKDSVLNTATKMKEVQTSTPAEQDLEMASEGEQKRLEEYENNQPQVKNQIHSRDDLDDIIQSSQTVSEDGDSLCCNCKNVILLIDQHEMKCKDCVHLLKIKNTFCLWKRLIKLKDNHCEQLRVKIRKLKNKASVLQKRISEKEEIKSQLKHEILELEKELCSLRFAIQQEKKKRRNVEELHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNGETLAKTIACYSGQLAALTDENTTLRSKLEKQRESRQRLETEMQSYRCRLNAARCDHDQSHSSKRDQELAFQGTVDKCRHLQENLNSHVLILSLQLSKAESKSRVLKTELHYTGEALKEKALVFEHVQSELKQKQSQMKDIEKMYKSGYNTMEKCIEKQERFCQLKKQNMLLQQQLDDARNKADNQEKAILNIQARCDARVQNLQAECRKHRLLLEEDNKMLVNELNHSKEKECQYEKEKAEREVAVRQLQQKRDDVLNKGSATKALLDASSRHCTYLENGMQDSRKKLDQMRSQFQEIQDQLTATIRCTKEMEGDTQKLEVEHVMMRKIIKKQDDQIERLEKILQHSSLMLQVFES

SEQ ID NO: 5250 - protein, 618 aa, Homo sapiens
  Payload ID: 1143;
  Gene Symbol: ANKRD36C;
  Gene Name: ankyrin repeat domain 36C;
  Uniprot ID:  Q5JPF3;
  ENSP ID: ENSP00000295246
MRRKDSPPPGKVSSQKQPAEKATSDDKDSVSNIATEIKEGPISGTVSSQKQPAEKATSDEKDSVSNIATEIKEGQQSGTVSPQKQSAWKVIFKKKVSLLNIATRITGGGKSGTVSSQKQPPSKATSDKTDSALNIATEIKDGLQCGTVSSQKQPALKATTDEEDSVSNIATEIKDGEKSGTVSSQKQPALKATTDEEDSVSIIATEIKDGEKSGTVSSRKKPALKATSDEKDSFSNITREKKDGEISRTVTSEKPAGLKATSDEEDSVLNIARGKEDGEKTRRVSSRKKPALKATSDEKDSFSNITREKKDGETSRTVSSQKPPALKATSDEEDSVLNIAREKKDGEKSRTVSSEKPSGLKATSDEKDSVLNIARGKKHGEKTRRVSSHKQPALKATSDKENSVPNMATETKDEQISGTVSSQKQPALKATSDKKDSVSNIPTEIKDGQQSGTVSSQKQLAWKATSVKKDSVSNIATEIKDGQIRGTVSSQRQPALKATGDEKDSVSNIAREIKDGEKSGTVSPQKQSAQKVIFKKKVSLLNIATRITGGWKSGTEYPENLPTLKATIENKNSVLNTATKMKDVQTSTPEQDLEMASEGEQKRLEEYENNQPQIVFTY

SEQ ID NO: 5251 - protein, 1778 aa, Homo sapiens
  Payload ID: 1143;
  Gene Symbol: ANKRD36C;
  Gene Name: ankyrin repeat domain 36C;
  Uniprot ID:  Q5JPF3;
  ENSP ID: ENSP00000403302
MDDKEPKRWPTLRDRLCSDGFLFPQYPIKPYHLKGIHRAVFYRDLEELKFVLLTRYDINKRDRKERTALHLACATGQPEMVHLLVSRRCELNLCDREDRTPLIKAVQLRQEACATLLLQNGADPNITDVFGRTALHYAVYNEDTSMIEKLLSYGANIEECSEDEYPPLFLAVSQRKVKMVEFLLKKKANINAVDYLGRSALIHAVTLGEKDIVILLLQHNIDVFSRDVYGKLAEDYASEAKNRVIFELIYEYERKKHEELSINSNPVSSQKQPALKATSGKEDSISNIATEIKDGQKSGTVSSQKQPALKGTSDKNDSVSNTATEIKDEQKSGTVSSQKQPALKDTSDKNDSVSNTATEIKDEQKSGTVLPAVEQCLNRSLYRPDAVAQPVTEDEFALESEIISKLYIPKRKIISPRSIEDVLPPVEEAVDRCLYLLDRFAQAVTKDKFALESENISEPYFTNRRTISQQSAEKLDAACGIDKTENGTLFEDQNVDKEGKALPATGQKANVSPEQPPLFTHTVKDSDHISTRFLGSMDSLTSSEESSERPPLSTLTLKEADPSSKAAMRRKDSPPPGKVSSQKQPAEKATSDDKDSVSNIATEIKEGPISGTVSSQKQPAEKATSDEKDSVSNIATEIKEGQQSGTVSPQKQSAWKVIFKKKVSLLNIATRITGGGKSGTVSSQKQPPSKATSDKTDSALNIATEIKDGLQCGTVSSQKQPALKATTDEEDSVSNIATEIKDGEKSGTVSSQKQPALKATTDEEDSVSIIATEIKDGEKSGTVSSRKKPALKATSDEKDSFSNITREKKDGEISRTVTSEKPAGLKATSDEEDSVLNIARGKEDGEKTRRVSSRKKPALKATSDEKDSFSNITREKKDGETSRTVSSQKPPALKATSDEEDSVLNIAREKKDGEKSRTVSSEKPSGLKATSDEKDSVLNIARGKKHGEKTRRVSSHKQPALKATSDKENSVPNMATETKDEQISGTVSSQKQPALKATSDKKDSVSNIPTEIKDGQQSGTVSSQKQLAWKATSVKKDSVSNIATEIKDGQIRGTVSSQRQPALKATGDEKDSVSNIAREIKDGEKSGTVSPQKQSAQKVIFKKKVSLLNIATRITGGWKSGTEYPENLPTLKATIENKNSVLNTATKMKDVQTSTPEQDLEMASEGEQKRLEEYENNQPQVKNQIHSRDDLDDIIQSSQTVSEDGDSLCCNCKNVILLIDQHEMKCKDCVHLLKIKKTFCLCKRLTELKDNHCEQLRVKIRKLKNKASVLQKRLSEKEEIKSQLKHETLELEKELCSLRFAIQQEKKKRRNVEELHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNEETLAETIACYSGQLAALTDENTTLRSKLEKQRESGQRLETEMQSYRCRLNAALCDHDQSHSSKRDQELAFQGTVDKCCHLQENLNSHVLILSLQLSKAESKFRVLETELHYTGEALKEKALVFEHVQSELKQKQSQMKDIEKMYKSGYNTMEKCIEKQERFCQLKKQNMLLQQQLDDARNKADNQEKAILNIQARCDARVENLQAECRKHRLLLEEDNKMLVNELNHSKEKKCQYEKEKAEREVAVRQLQQKQDDVLNKRSATKALLDASSRHCIYLENGMQDSRKKLDQMRSQFQEIQDQLTATIRCTKEMEGDAQKLEVENVMMRKIIKKQDEQIERFEKILQHSSLMLQVFES

SEQ ID NO: 5252 - protein, 532 aa, Homo sapiens
  Payload ID: 1143;
  Gene Symbol: ANKRD36C;
  Gene Name: ankyrin repeat domain 36C;
  ENSP ID: ENSP00000431824
MDDKEPKRWPTLRDRLCSDGFLFPQYPIKPYHLKGIHRAVFYRDLEELKFVLLTRYDINKRDRKERTALHLACATGQPEMVHLLVSRRCELNLCDREDRTPLIKAVQLRQEACATLLLQNGADPNITDVFGRTALHYAVYNEDTSMIEKLLSYGANIEECSEDEYPPLFLAVSQRKVKMVEFLLKKKANINAVDYLGRSALIHAVTLGEKDIVILLLQHNIDVFSRDVYGKLAEDYASEAKNRVIFELIYEYERKKHEELSINSNPVSSQKQPALKATSGKEDSISNIATEIKDGQKSGTVSSQKQPALKGTSDKNDSVSNTATEIKDEQKSGTVSSQKQPALKDTSDKNDSVSNTATEIKDEQKSGTVLPAVEQCLNRSLYRPDAVAQPVTEDEFALESEIISKLYIPKRKIISPRSIEDVLPPVEEAVDRCLYLLDRFAQAVTKDKFALESENISEPYFTNRRTISQQSAEKLDAACGIDKTENGTLFEDQNVDKEGKALPATGQKANVSPEQPPLFTNLLSDLLYPRLL

SEQ ID NO: 5253 - protein, 61 aa, Homo sapiens
  Payload ID: 1143;
  Gene Symbol: ANKRD36C;
  Gene Name: ankyrin repeat domain 36C;
  ENSP ID: ENSP00000433685
  MOD_RES (1)..(1): Any amino acid
XEKLDAACGIDKTENGTLFEDQNVDKEGKALPATGQKANVSPEQPPLFTNLLSDLLYPRLL

SEQ ID NO: 5254 - protein, 163 aa, Homo sapiens
  Payload ID: 1143;
  Gene Symbol: ANKRD36C;
  Gene Name: ankyrin repeat domain 36C;
  ENSP ID: ENSP00000482131
MDDKEPKRWPTLRDRLCSDGFLFPQYPIKPYHLKGIHRAVFYRDLEELKFVLLTRYDINKRDRKERTALHLACATGQPEMVHLLVSRRCELNLCDREDRTPLIKAVQLRQEACATLLLQNGADPNITDVFGRTALHYAVYNEDTSMIEKLLSYGANIEECSEV

SEQ ID NO: 5255 - protein, 137 aa, Homo sapiens
  Payload ID: 1143;
  Gene Symbol: ANKRD36C;
  Gene Name: ankyrin repeat domain 36C;
  ENSP ID: ENSP00000485004
MLVNELNHSKEKKCQYEKEKAEREVAVRQLQQKQDDVLNKRSATKALLDASSRHCIYLENGMQDSRKKLDQMRSQFQEIQDQLTATIRCTKEMEGDAQKLEVENVMMRKIIKKQDEQIERFEKILQHSSLMLQVFES

SEQ ID NO: 5256 - protein, 158 aa, Homo sapiens
  Payload ID: 1144;
  Gene Symbol: ANKRD37;
  Gene Name: ankyrin repeat domain 37;
  Uniprot ID:  Q7Z713;
  ENSP ID: ENSP00000335147
MLLLDCNPEVDGLKHLLETGASVNAPPDPCKQSPVHLAAGSGLACFLLWQLQTGADLNQQDVLGEAPLHKAAKVGSLECLSLLVASDAQIDLCNKNGQTAEDLAWSCGFPDCAKFLTTIKCMQTIKASEHPDRNDCVAVLRQKRSLGSVENTSGKRKC

SEQ ID NO: 5257 - protein, 44 aa, Homo sapiens
  Payload ID: 1144;
  Gene Symbol: ANKRD37;
  Gene Name: ankyrin repeat domain 37;
  ENSP ID: ENSP00000421529
MLLLDCNPEVDGLKHLLETGASVNAPPDPCKQSPVHLAAGSGLA

SEQ ID NO: 5258 - protein, 183 aa, Homo sapiens
  Payload ID: 1145;
  Gene Symbol: ANKRD39;
  Gene Name: ankyrin repeat domain 39;
  Uniprot ID:  Q53RE8;
  ENSP ID: ENSP00000377170
MATPRPCADGPCCSHPSAVLGVQQTLEEMDFERGIWSAALNGDLGRVKHLIQKAEDPSQPDSAGYTALHYASRNGHYAVCQFLLESGAKCDAQTHGGATALHRASYCGHTEIARLLLSHGSNPRVVDDDGMTSLHKAAERGHGDICSLLLQHSPALKAIRDRKARLACDLLPCNSDLRDLLSS

SEQ ID NO: 5259 - protein, 183 aa, Homo sapiens; identical to SEQ ID NO: 5258
  Payload ID: 1145;
  Gene Symbol: ANKRD39;
  Gene Name: ankyrin repeat domain 39;
  Uniprot ID:  Q53RE8;
  ENSP ID: ENSP00000398321

SEQ ID NO: 5260 - protein, 368 aa, Homo sapiens
  Payload ID: 1146;
  Gene Symbol: ANKRD40;
  Gene Name: ankyrin repeat domain 40;
  Uniprot ID:  Q6AI12;
  ENSP ID: ENSP00000285243
MNALLEQKEQQERLREAAALGDIREVQKLVESGVDVNSQNEVNGWTCLHWACKRNHGQVVSYLLKSGADKEILTTKGEMPVQLTSRREIRKIMGVEEEDDDDDDDDNLPQLKKESELPFVPNYLANPAFPFIYTPTAEDSAQMQNGGPSTPPASPPADGSPPLLPPGEPPLLGTFPRDHTSLALVQNGDVSAPSAILRTPESTKPGPVCQPPVSQSRSLFSSVPSKPPMSLEPQNGTYAGPAPAFQPFFFTGAFPFNMQELVLKVRIQNPSLRENDFIEIELDRQELTYQELLRVCCCELGVNPDQVEKIRKLPNTLLRKDKDVARLQDFQELELVLMISENNFLFRNAASTLTERPCYNRRASKLTY

SEQ ID NO: 5261 - protein, 122 aa, Homo sapiens
  Payload ID: 1146;
  Gene Symbol: ANKRD40;
  Gene Name: ankyrin repeat domain 40;
  ENSP ID: ENSP00000468442
MPVQLTSRREIRKIMGVEEEDDDDDDDDNLPQLKKESELPFVPNYLANPAFPFIYTPTAEDSAQMQNGGPSTPPASPPADGSPPLLPPGEPPLLGTFPRDHTSLALVQNGDVSAPSAILRTP

SEQ ID NO: 5262 - protein, 517 aa, Homo sapiens
  Payload ID: 1147;
  Gene Symbol: ANKRD42;
  Gene Name: ankyrin repeat domain 42;
  ENSP ID: ENSP00000260047
MPGVANSGPSTSSRETANPCSRKKVHFGSIHDAVRAGDVKQLSEIVVRGASINELDVLHKFTPLHWAAHSGSLECLHWLLWHGADITHVTTRGWTASHIAAIRGQDACVQALIMNGANLTAQDDRGCTPLHLAATHGHSFTLQIMLRSGDPSVTDKREWRPVHYAAFHGRLGCLQLLVKWGCSIEDVDYNGNLPVHLAAMEGHLHCFKFLVSRMSSATQVLKAFNDNGENVLDLAQRFFKQNILQFIQGAEYEGKDLEDQETLAFPGHVAAFKGDLGMLKKLVEDGVININERADNGSTPMHKAAGQGHIECLQWLIKMGADSNITNKAGERPSDVAKRFAHLAAVKLLEELQKYDIDDENEIDENDVKYFIRHGVEGSTDAKDDLCLSDLDKTDARMRAYKKIVELRHLLEIAESNYKHLGGITEEDLKQKKEQLESEKTIKELQGQLEYERLRREKLECQLDEYRAEVDQLRETLEKIQVPNFVAMEDSASCESNKEKRRVKKKVSSGGVFVRRY

SEQ ID NO: 5263 - protein, 198 aa, Homo sapiens
  Payload ID: 1147;
  Gene Symbol: ANKRD42;
  Gene Name: ankyrin repeat domain 42;
  Uniprot ID:  Q8N9B4;
  ENSP ID: ENSP00000377049
MPGVANSGPSTSSRETANPCSRKKVHFGSIHDAVRAGDVKQLSEIVVRGASINELDVLHKFTPLHWAAHSGSLECLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCSIEDVDYNGNLPEPP

SEQ ID NO: 5264 - protein, 389 aa, Homo sapiens
  Payload ID: 1147;
  Gene Symbol: ANKRD42;
  Gene Name: ankyrin repeat domain 42;
  Uniprot ID:  Q8N9B4;
  ENSP ID: ENSP00000377051
MPGVANSGPSTSSRETANPCSRKKVHFGSIHDAVRAGDVKQLSEIVCLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCSIEDVDYNGNLPVHLAAMEGHLHCFKFLVSRMSSATQVLKAFNDNGENVLDLAQRFFKQNILQFIQGAEYEGKDLEDQETLAFPGHVAAFKGDLGMLKKLVEDGVININERADNGSTPMHKAAGQGHIECLQWLIKMGADSNITNKAGERPSDVAKRFAHLAAVKLLEELQKYDIDDENEIDENDVKYFIRHGVEGSTDAKDDLCLSDLDKTDARRPSKNCRASWSMNDYVEKN

SEQ ID NO: 5265 - protein, 85 aa, Homo sapiens
  Payload ID: 1147;
  Gene Symbol: ANKRD42;
  Gene Name: ankyrin repeat domain 42;
  ENSP ID: ENSP00000432375
MNGANLTAQDDRGCTPLHLAATHGHSFTLQIMLRSGVDPSVTDKREWRPVHYAAFHGRLGCLQLLVKWGCSIEDVDYNGNLPEPP

SEQ ID NO: 5266 - protein, 230 aa, Homo sapiens
  Payload ID: 1147;
  Gene Symbol: ANKRD42;
  Gene Name: ankyrin repeat domain 42;
  ENSP ID: ENSP00000433585
MPGVANSGPSTSSRETANPCSRKKVHFGSIHDAVRAGDVKQLSEIVVRGASINELDVLHKFTPLHWAAHSGSLECLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCSIEDVDYNGNLPGGSHLLLSIMATLRPLVKPRIIKKRTKKFFRHQTD

SEQ ID NO: 5267 - protein, 502 aa, Homo sapiens
  Payload ID: 1147;
  Gene Symbol: ANKRD42;
  Gene Name: ankyrin repeat domain 42;
  ENSP ID: ENSP00000434666
MPGVANSGPSTSSRETANPCSRKKVHFGSIHDAVRAGDVKQLSEIVVRGASINELDVLHKFTPLHWAAHSGSLECLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCSIEDVDYNGNLPVHLAAMEGHLHCFKFLVSRMSSATQVLKAFNDNGENVLDLAQRFFKQNILQFIQGAEYEGKDLEDQETLAFPGHVAAFKGDLGMLKKLVEDGVININERADNGSTPMHKAAGQGHIECLQWLIKMGADSNITNKAGERPSDVAKRFAHLAAVKLLEELQKYDIDDENEIDENDVKYFIRHGVEGSTDAKDDLCLSDLDKTDARMRAYKKIVELRHLLEIAESNYKHLGGITEEDLKQKKEQLESEKTIKELQGQLEYERLRREKLECQLDEYRAEVDQLRETLEKIQVPNFVAMTALLVSQTKRRGE

SEQ ID NO: 5268 - protein, 142 aa, Homo sapiens
  Payload ID: 1147;
  Gene Symbol: ANKRD42;
  Gene Name: ankyrin repeat domain 42;
  ENSP ID: ENSP00000435197
DLGMLKKLVEDGVININERADNGSTPMHKAAGQGHIECLQWLIKMGADSNITNKAGERPSDVAKRTIKELQGQLEYERLRREKLECQLDEYRAEVDQLRETLEKIQVPNFVAMEDSASCESNKEKRRVKKKVSSGGVFVRRY

SEQ ID NO: 5269 - protein, 527 aa, Homo sapiens
  Payload ID: 1147;
  Gene Symbol: ANKRD42;
  Gene Name: ankyrin repeat domain 42;
  ENSP ID: ENSP00000435790
MPGVANSGPSTSSRETANPCSRKKVHFGSIHDAVRAGDVKQLSEIVVRGASINELDVLHKFTPLHWAAHSGSLECLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCSIEDVDYNGNLPVHLAAMEGHLHCFKFLVSRMSSATQVLKAFNDNGENVLDLAQRFFKQNILQFIQGAEYEGKDLEDQETLAFPGHVAAFKGDLGMLKKLVEDGVININERADNGSTPMHKAAGQGHIECLQWLIKMGADSNITNKAGERPSDVAKRFAHLAAVKLLEELQKYDIDDENEIDENDVKYFIRHGVEGSTDAKDDLCLSDLDKTDARMRAYKKIVELRHLLEIAESNYKHLGGITEEDLKQKKEQLESEKTIKELQGQLEYERLRREKLECQLDEYRAEVDQLRETLEKIQVPNFVAMVGVLFNTFIFLKKYIQEWPRVQALGWGSLDLNPGYSLF

SEQ ID NO: 5270 - protein, 993 aa, Homo sapiens
  Payload ID: 1148;
  Gene Symbol: ANKRD44;
  Gene Name: ankyrin repeat domain 44;
  Uniprot ID:  Q8N8A2;
  ENSP ID: ENSP00000282272
MAVLKLTDQPPLVQAIFSGDPEEIRMLIHKTEDVNTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLAKGANINAFDKKDRRALHWAAYMGHLDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELLLERTNSGFEESDSGATKSPLHLAAYNGHHQALEVLLQSLVDLDIRDEKGRTALDLAAFKGHTECVEALINQGASIFVKDNVTKRTPLHASVINGHTLCLRLLLEIADNPEAVDVKDAKGQTPLMLAVAYGHIDAVSLLLEKEANVDTVDILGCTALHRGIMTGHEECVQMLLEQEVSILCKDSRGRTPLHYAAARGHATWLSELLQMALSEEDCCFKDNQGYTPLHWACYNGNENCIEVLLEQKCFRKFIGNPFTPLHCAIINDHGNCASLLLGAIDSSIVSCRDDKGRTPLHAAAFADHVECLQLLLRHSAPVNAVDNSGKTALMMAAENGQAGAVDILVNSAQADLTVKDKDLNTPLHLACSKGHEKCALLILDKIQDESLINEKNNALQTPLHVAARNGLKVVVEELLAKGACVLAVDENASRSNGPRSTPGTAVQKEE

SEQ ID NO: 5271 - protein, 919 aa, Homo sapiens
  Payload ID: 1148;
  Gene Symbol: ANKRD44;
  Gene Name: ankyrin repeat domain 44;
  Uniprot ID:  Q8N8A2;
  ENSP ID: ENSP00000331516
MLIHKTEDVNTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLAKGANINAFDKKDRRALHWAAYMGHLDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELLLERTNSGFEESDSGATKSPLHLAAYNGHHQALEVLLQSLVDLDIRDEKGRTALDLAAFKGHTECVEALINQGASIFVKDNVTKRTPLHASVINGHTLCLRLLLEIADNPEAVDVKDAKGQTPLMLAVAYGHIDAVSLLLEKEANVDTVDILGCTALHRGIMTGHEECVQMLLEQEVSILCKDSRGRTPLHYAAARGHATWLSELLQMALSEEDCCFKDNQGYTPLHWACYNGNENCIEVLLEQKCFRKFIGNPFTPLHCAIINDHGNCASLLLGAIDSSIVSCRDDKGRTPLHAAAFADHVECLQLLLRHSAPVNAVDNSGKTALMMAAENGQAGAVDILVNSAQADLTVKDKDLNTPLHLACSKGHEKCALLILDKIQDESLINEKNNALQT

SEQ ID NO: 5272 - protein, 579 aa, Homo sapiens
  Payload ID: 1148;
  Gene Symbol: ANKRD44;
  Gene Name: ankyrin repeat domain 44;
  Uniprot ID:  Q8N8A2;
  ENSP ID: ENSP00000387141
MAVLKLTDQPPLVQAIFSGDPEEIRMLIHKTEDVNTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLAKGANINAFDKKDRRALHWAAYMGHLDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELVSCFVLFSLTHTHTHTPNHRGINCFFPEL

SEQ ID NO: 5273 - protein, 367 aa, Homo sapiens
  Payload ID: 1148;
  Gene Symbol: ANKRD44;
  Gene Name: ankyrin repeat domain 44;
  Uniprot ID:  Q8N8A2;
  ENSP ID: ENSP00000387233
MAVLKLTDQPPLVQAIFSGDPEEIRMLIHKTEDVNTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLAKGANINAFDKKDRRALHWAAYMGHLDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAK

SEQ ID NO: 5274 - protein, 76 aa, Homo sapiens
  Payload ID: 1148;
  Gene Symbol: ANKRD44;
  Gene Name: ankyrin repeat domain 44;
  ENSP ID: ENSP00000399895
MLIHKTEDVNTLDSEKRTPLHVAAFLGDAEIIELLILSGARVNAKDNMWLTPLHRAVASRSEEAVQVLIKHSADVN

SEQ ID NO: 5275 - protein, 791 aa, Homo sapiens
  Payload ID: 1148;
  Gene Symbol: ANKRD44;
  Gene Name: ankyrin repeat domain 44;
  ENSP ID: ENSP00000403415
KKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGQKYSIVSLFSNEHVLSAGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELLLERTNSGFEESDSGATKSPLHLAAYNGHHQALEVLLQSLVDLDIRDEKGRTALDLAAFKGHTECVEALINQGASIFVKDNVTKRTPLHASVINGHTLCLRLLLEIADNPEAVDVKDAKGQTPLMLAVAYGHIDAVSLLLEKEANVDTVDILGCTALHRGIMTGHEECVQMLLEQEVSILCKDSRGRTPLHYAAARGHATWLSELLQMALSEEDCCFKDNQGYTPLHWACYNGNENCIEVLLEQKCFRKFIGNPFTPLHCAIINDHGNCASLLLGAIDSSIVSCRDDKGRTPLHAAAFADHVECLQLLLRHSAPVNAVDNSGKTALMMAAENGQAGAVDILVNSAQADLTVKDKDLNTPLHLACSKGHEKCALLILDKIQDESLINEKNNALQTPLHVAARNGLKVVVEELLAKGACVLAVDENGC

SEQ ID NO: 5276 - protein, 40 aa, Homo sapiens
  Payload ID: 1148;
  Gene Symbol: ANKRD44;
  Gene Name: ankyrin repeat domain 44;
  ENSP ID: ENSP00000405983
MAVLKLTDQPPLVQAIFSGDPEEIRMLIHKTEDVNTLELV

SEQ ID NO: 5277 - protein, 182 aa, Homo sapiens
  Payload ID: 1148;
  Gene Symbol: ANKRD44;
  Gene Name: ankyrin repeat domain 44;
  ENSP ID: ENSP00000413091
  MOD_RES (1)..(1): Any amino acid
XINDHGNCASLLLGAIDSSIVSCRDDKGRTPLHAAAFADHVECLQLLLRHSAPVNAVDNSGKTALMMAAENGQAGAVDILVNSAQADLTVKDKDLNTPLHLACSKGHEKCALLILDKIQDESLINEKNNALQTPLHVAARNGLKVVVEELLAKGACVLAVDENASRSNGPRSTPGTAVQKEE

SEQ ID NO: 5278 - protein, 316 aa, Homo sapiens
  Payload ID: 1148;
  Gene Symbol: ANKRD44;
  Gene Name: ankyrin repeat domain 44;
  ENSP ID: ENSP00000416319
SKDGKSPLHMTAVHGRFTRSQTLIQNGGEIDCVDKDGNTPLHVAARYGHELLINTLITSGADTAKCGIHSMFPLHLAALNAHSDCCRKLLSSGFEIDTPDKFGRTCLHAAAAGGTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELLLERTNSGFEESDSGATKSPLHLAAYNGHHQALEVLLQSLVDLDIRDEKGRTALDLAAFKGHTECVEALINQGASIFVKDNVTKRTPLHAS

SEQ ID NO: 5279 - protein, 266 aa, Homo sapiens
  Payload ID: 1149;
  Gene Symbol: ANKRD45;
  Gene Name: ankyrin repeat domain 45;
  Uniprot ID:  Q5TZF3;
  ENSP ID: ENSP00000331268
MESEGPPESESSEFFSQQEEENEEEEAQEPEETGPKNPLLQPALTGDVEGLQKIFEDPENPHHEQAMQLLLEEDIVGRNLLYAACMAGQSDVIRALAKYGVNLNEKTTRGYTLLHCAAAWGRLETLKALVELDVDIEALNFREERARDVAARYSQTECVEFLDWADARLTLKKYIAKVSLAVTDTEKGSGKLLKEDKNTILSACRAKNEWLETHTEASINELFEQRQQLEDIVTPIFTKMTTPCQVKSAKSVTSHDQKRSQDDTSN

SEQ ID NO: 5280 - protein, 228 aa, Homo sapiens
  Payload ID: 1150;
  Gene Symbol: ANKRD46;
  Gene Name: ankyrin repeat domain 46;
  Uniprot ID:  Q86W74;
  ENSP ID: ENSP00000335287
MSYVFVNDSSQTNVPLLQACIDGDFNYSKRLLESGFDPNIRDSRGRTGLHLAAARGNVDICQLLHKFGADLLATDYQGNTALHLCGHVDTIQFLVSNGLKIDICNHQGATPLVLAKRRGVNKDVIRLLESLEEQEVKGFNRGTHSKLETMQTAESESAMESHSLLNPNLQQGEGVLSSFRTTWQEFVEDLGFWRVLLLIFVIALLSLGIAYYVSGVLPFVENQPELVH

SEQ ID NO: 5281 - protein, 195 aa, Homo sapiens
  Payload ID: 1150;
  Gene Symbol: ANKRD46;
  Gene Name: ankyrin repeat domain 46;
  ENSP ID: ENSP00000351881
MSYVFVNDSSQTNVPLLQACIDGDFNYSKRLLESGFDPNIRDSRGRTGLHLAAARGNVDICQLLHKFGADLLATDYQGNTALHLCGHVDTIQFLVSNGLKIDICNHQGATPLVLAKRRGVNKDVIRLLESLEEQEVKGFNRGTHSKLETMQTAESESAMESHSLLNPNLQQGEGVLSSFRTTWQEFVEDLGFWRV

SEQ ID NO: 5282 - protein, 228 aa, Homo sapiens; identical to SEQ ID NO: 5280
  Payload ID: 1150;
  Gene Symbol: ANKRD46;
  Gene Name: ankyrin repeat domain 46;
  Uniprot ID:  Q86W74;
  ENSP ID: ENSP00000428388

SEQ ID NO: 5283 - protein, 232 aa, Homo sapiens
  Payload ID: 1150;
  Gene Symbol: ANKRD46;
  Gene Name: ankyrin repeat domain 46;
  Uniprot ID:  Q86W74;
  ENSP ID: ENSP00000429015
MSYVFVNDSSQTNVPLLQACIDGDFNYSKRLLESGFDPNIRDSRGRTGLHLAAARGNVDICQLLHKFGADLLATDYQGNTALHLCGHVDTIQFLVSNGLKIDICNHQGATPLVLAKRRGVNKDVIRLLESLEEQEVKGFNRGTHSKLETMQTAESESAMESHSLLNPNLQQGEGVLSSFRTTWQEFVEDLGFWRVLLLIFVIALLSLGIAYYRRTLRLGSFARQDRSRIQAI

SEQ ID NO: 5284 - protein, 82 aa, Homo sapiens
  Payload ID: 1150;
  Gene Symbol: ANKRD46;
  Gene Name: ankyrin repeat domain 46;
  ENSP ID: ENSP00000429647
MSYVFVNDSSQTNVPLLQACIDGDFNYSKRLLESGFDPNIRDSRGRTGLHLAAARGNVDICQLLHKFGADLLATDYQGNTAL

SEQ ID NO: 5285 - protein, 228 aa, Homo sapiens; identical to SEQ ID NO: 5280
  Payload ID: 1150;
  Gene Symbol: ANKRD46;
  Gene Name: ankyrin repeat domain 46;
  Uniprot ID:  Q86W74;
  ENSP ID: ENSP00000430056

SEQ ID NO: 5286 - protein, 103 aa, Homo sapiens
  Payload ID: 1150;
  Gene Symbol: ANKRD46;
  Gene Name: ankyrin repeat domain 46;
  ENSP ID: ENSP00000430357
MSYVFVNDSSQTNVPLLQACIDGDFNYSKRLLESGFDPNIRDSRGRTGLHLAAARGNVDICQLLHKFGADLLATDYQGNTALHLCGHVDTIQFLVSNGLKIDI

SEQ ID NO: 5287 - protein, 85 aa, Homo sapiens
  Payload ID: 1150;
  Gene Symbol: ANKRD46;
  Gene Name: ankyrin repeat domain 46;
  ENSP ID: ENSP00000430800
MSYVFVNDSSQTNVPLLQACIDGDFNYSKRLLESGFDPNIRDSRGRTGLHLAAARGNVDICQLLHKFGADLLATDYQGNTALHLC

SEQ ID NO: 5288 - protein, 175 aa, Homo sapiens
  Payload ID: 1150;
  Gene Symbol: ANKRD46;
  Gene Name: ankyrin repeat domain 46;
  ENSP ID: ENSP00000430827
MSYVFVNDSSQTNVPLLQACIDGDFNYSKRLLESGFDPNIRDSRGRTGLHLAAARGNVDICQLLHKFGADLLATDYQGNTALHLCGHVDTIQFLVSNGLKIDICAMESHSLLNPNLQQGEGVLSSFRTTWQEFVEDLGFWRVLLLIFVIALLSLGIAYYVSGVLPFVENQPELVH

SEQ ID NO: 5289 - protein, 239 aa, Homo sapiens
  Payload ID: 1151;
  Gene Symbol: ANKRD49;
  Gene Name: ankyrin repeat domain 49;
  Uniprot ID:  Q8WVL7;
  ENSP ID: ENSP00000303518
MEKEKGNDDGIPDQENSLDFSEHFNQLELLETHGHLIPTGTQSLWVGNSDEDEEQDDKNEEWYRLQEKKMEKDPSRLLLWAAEKNRLTTVRRLLSEKATHVNTRDEDEYTPLHRAAYSGHLDIVQELIAQGADVHAVTVDGWTPLHSACKWNNTRVASFLLQHDADINAQTKGLLTPLHLAAGNRDSKDTLELLLMNRYVKPGLKNNLEETAFDIARRTSIYHYLFEIVEGCTNSSPQS

SEQ ID NO: 5290 - protein, 125 aa, Homo sapiens
  Payload ID: 1151;
  Gene Symbol: ANKRD49;
  Gene Name: ankyrin repeat domain 49;
  ENSP ID: ENSP00000438506
MEKEKGNDDGIPDQENSLDFSEHFNQLELLETHGHLIPTGTQSLWVGNSDEDEEQDDKNEEWYRLQEKKMEKDPSRLLLWAAEKNRVKKKITEGSVTVGKALGSSQKTCLYCYGHHTYLLIVRTK

SEQ ID NO: 5291 - protein, 111 aa, Homo sapiens
  Payload ID: 1151;
  Gene Symbol: ANKRD49;
  Gene Name: ankyrin repeat domain 49;
  ENSP ID: ENSP00000439200
MEKEKGNDDGIPDQENSLDFSEHFNQLELLETHGHLIPTGTQSLWVGNSDEDEEQDDKNEEWYRLQEKKMEKDPSRLLLWAAEKNRVKKKITEGSVTVGKALGSSQKTCLY

SEQ ID NO: 5292 - protein, 239 aa, Homo sapiens; identical to SEQ ID NO: 5289
  Payload ID: 1151;
  Gene Symbol: ANKRD49;
  Gene Name: ankyrin repeat domain 49;
  Uniprot ID:  Q8WVL7;
  ENSP ID: ENSP00000440396

SEQ ID NO: 5293 - protein, 146 aa, Homo sapiens
  Payload ID: 1151;
  Gene Symbol: ANKRD49;
  Gene Name: ankyrin repeat domain 49;
  ENSP ID: ENSP00000441877
MEKEKGNDDGIPDQENSLDFSEHFNQLELLETHGHLIPTGTQSLWVGNSDEDEEQDDKNEEWYRLQEKKMEKDPSRLLLWAAEKNRVKKKITEGSVTVGKALGSSQKTCLYCYGHHTYLLILTTVRRLLSEKATHVNTRDEDEYTP

SEQ ID NO: 5294 - protein, 130 aa, Homo sapiens
  Payload ID: 1151;
  Gene Symbol: ANKRD49;
  Gene Name: ankyrin repeat domain 49;
  ENSP ID: ENSP00000442449
MEKEKGNDDGIPDQENSLDFSEHFNQLELLETHGHLIPTGTQSLWLTTVRRLLSEKATHVNTRDEDEYTPLHRAAYSGHLDIVQELIAQGADVHAVTVDGWTPLHSACKWNNTRVASFLLQHDADINAQT

SEQ ID NO: 5295 - protein, 125 aa, Homo sapiens; identical to SEQ ID NO: 5290
  Payload ID: 1151;
  Gene Symbol: ANKRD49;
  Gene Name: ankyrin repeat domain 49;
  ENSP ID: ENSP00000444030

SEQ ID NO: 5296 - protein, 86 aa, Homo sapiens
  Payload ID: 1151;
  Gene Symbol: ANKRD49;
  Gene Name: ankyrin repeat domain 49;
  ENSP ID: ENSP00000445597
MEKEKGNDDGIPDQENSLDFSEHFNQLELLETHGHLIPTGTQSLWVGNSDEDEEQDDKNEEWYRLQEKKMEKDPSRLLLWAAEKNR

SEQ ID NO: 5297 - protein, 125 aa, Homo sapiens; identical to SEQ ID NO: 5290
  Payload ID: 1151;
  Gene Symbol: ANKRD49;
  Gene Name: ankyrin repeat domain 49;
  ENSP ID: ENSP00000446433

SEQ ID NO: 5298 - protein, 1250 aa, Homo sapiens
  Payload ID: 1152;
  Gene Symbol: ANKRD50;
  Gene Name: ankyrin repeat domain 50;
  Uniprot ID:  Q9ULJ7;
  ENSP ID: ENSP00000425355
MKPPQQSLYLLVDSVDEGCNITEGEQTSTSLSGTVAALLAGHHEFFPPWLLLLCSARKQSKAVTKMFTGFRKISLDDLRKAYIVKDVQQYILHRLDQEEALRQHLTKETAEMLNQLHIKSSGCFLYLERVLDGVVENFIMLREIRDIPGTLNGLYLWLCQRLFVRKQFAKVQPILNVILAACRPLTITELYHAVWTKNMSLTLEDFQRKLDILSKLLVDGLGNTKILFHYSFAEWLLDVKHCTQKYLCNAAEGHRMLAMSYTCQAKNLTPLEAQEFALHLINSNLQLETAELALWMIWNGTPVRDSLSTLIPKEQEVLQLLVKAGAHVNSEDDRTSCIVRQALEREDSIRTLLDNGASVNQCDSNGRTLLANAAYSGSLDVVNLLVSRGADLEIEDAHGHTPLTLAARQGHTKVVNCLIGCGANINHTDQDGWTALRSAAWGGHTEVVSALLYAGVKVDCADADSRTALRAAAWGGHEDIVLNLLQHGAEVNKADNEGRTALIAAAYMGHREIVEHLLDHGAEVNHEDVDGRTALSVAALCVPASKGHASVVSLLIDRGAEVDHCDKDGMTPLLVAAYEGHVDVVDLLLEGGADVDHTDNNGRTPLLAAASMGHASVVNTLLFWGAAVDSIDSEGRTVLSIASAQGNVEVVRTLLDRGLDENHRDDAGWTPLHMAAFEGHRLICEALIEQGARTNEIDNDGRIPFILASQEGHYDCVQILLENKSNIDQRGYDGRNALRVAALEGHRDIVELLFSHGADVNCKDADGRPTLYILALENQLTMAEYFLENGANVEASDAEGRTALHVSCWQGHMEMVQVLIAYHADVNAADNEKRSALQSAAWQGHVKVVQLLIEHGAVVDHTCNQGATALCIAAQEGHIDVVQVLLEHGADPNHADQFGRTAMRVAAKNGHSQIIKLLEKYGASSLNGCSPSPVHTMEQKPLQSLSSKVQSLTIKSNSSGSTGGGDMQPSLRGLPNGPTHAFSSPSESPDSTVDRQKSSLSNNSLKSSKNSSLRTTSSTATAQTVPIDSFHNLSFTEQIQQHSLPRSRSRQSIVSPSSTTQSLGQSHNSPSSEFEWSQVKPSLKSTKASKGGKSENSAKSGSAGKKAKQSNSSQPKVLEYEMTQFDRRGPIAKSGTAAPPKQMPAESQCKIMIPSAQQEIGRSQQQFLIHQQSGEQKKRNGIMTNPNYHLQSNQVFLGRVSVPRTMQDRGHQEVLEGYPSSETELSLKQALKLQIEGSDPSFNYKKETPL

SEQ ID NO: 5299 - protein, 1429 aa, Homo sapiens
  Payload ID: 1152;
  Gene Symbol: ANKRD50;
  Gene Name: ankyrin repeat domain 50;
  Uniprot ID:  Q9ULJ7;
  ENSP ID: ENSP00000425658
MTNPWEEKVCKMAQTSLLQGKQFYCREWVFHKLQHCLQEKSNCCNSAVNAPSLVMNSGNNASGVSGKGAAWGVLLVGGPGSGKTALCTELLWPSSPASLQRGLHRQALAFHFCKAQDSDTLCVGGFIRGLVAQICRSGLLQGYEDKLRDPAVQSLLQPGECERNPAEAFKRCVLLPLLGMKPPQQSLYLLVDSVDEGCNITEGEQTSTSLSGTVAALLAGHHEFFPPWLLLLCSARKQSKAVTKMFTGFRKISLDDLRKAYIVKDVQQYILHRLDQEEALRQHLTKETAEMLNQLHIKSSGCFLYLERVLDGVVENFIMLREIRDIPGTLNGLYLWLCQRLFVRKQFAKVQPILNVILAACRPLTITELYHAVWTKNMSLTLEDFQRKLDILSKLLVDGLGNTKILFHYSFAEWLLDVKHCTQKYLCNAAEGHRMLAMSYTCQAKNLTPLEAQEFALHLINSNLQLETAELALWMIWNGTPVRDSLSTLIPKEQEVLQLLVKAGAHVNSEDDRTSCIVRQALEREDSIRTLLDNGASVNQCDSNGRTLLANAAYSGSLDVVNLLVSRGADLEIEDAHGHTPLTLAARQGHTKVVNCLIGCGANINHTDQDGWTALRSAAWGGHTEVVSALLYAGVKVDCADADSRTALRAAAWGGHEDIVLNLLQHGAEVNKADNEGRTALIAAAYMGHREIVEHLLDHGAEVNHEDVDGRTALSVAALCVPASKGHASVVSLLIDRGAEVDHCDKDGMTPLLVAAYEGHVDVVDLLLEGGADVDHTDNNGRTPLLAAASMGHASVVNTLLFWGAAVDSIDSEGRTVLSIASAQGNVEVVRTLLDRGLDENHRDDAGWTPLHMAAFEGHRLICEALIEQGARTNEIDNDGRIPFILASQEGHYDCVQILLENKSNIDQRGYDGRNALRVAALEGHRDIVELLFSHGADVNCKDADGRPTLYILALENQLTMAEYFLENGANVEASDAEGRTALHVSCWQGHMEMVQVLIAYHADVNAADNEKRSALQSAAWQGHVKVVQLLIEHGAVVDHTCNQGATALCIAAQEGHIDVVQVLLEHGADPNHADQFGRTAMRVAAKNGHSQIIKLLEKYGASSLNGCSPSPVHTMEQKPLQSLSSKVQSLTIKSNSSGSTGGGDMQPSLRGLPNGPTHAFSSPSESPDSTVDRQKSSLSNNSLKSSKNSSLRTTSSTATAQTVPIDSFHNLSFTEQIQQHSLPRSRSRQSIVSPSSTTQSLGQSHNSPSSEFEWSQVKPSLKSTKASKGGKSENSAKSGSAGKKAKQSNSSQPKVLEYEMTQFDRRGPIAKSGTAAPPKQMPAESQCKIMIPSAQQEIGRSQQQFLIHQQSGEQKKRNGIMTNPNYHLQSNQVFLGRVSVPRTMQDRGHQEVLEGYPSSETELSLKQALKLQIEGSDPSFNYKKETPL

SEQ ID NO: 5300 - protein, 1076 aa, Homo sapiens
  Payload ID: 1153;
  Gene Symbol: ANKRD52;
  Gene Name: ankyrin repeat domain 52;
  Uniprot ID:  Q8NB46;
  ENSP ID: ENSP00000267116
MGILSITDQPPLVQAIFSRDVEEVRSLLSQKENINVLDQERRTPLHAAAYVGDVPILQLLLMSGANVNAKDTLWLTPLHRAAASRNEKVLGLLLAHSADVNARDKLWQTPLHVAAANRATKCAEALAPLLSSLNVADRSGRSALHHAVHSGHLETVNLLLNKGASLNVCDKKERQPLHWAAFLGHLEVLKLLVARGADLGCKDRKGYGLLHTAAASGQIEVVKYLLRMGAEIDEPNAFGNTALHIACYLGQDAVAIELVNAGANVNQPNDKGFTPLHVAAVSTNGALCLELLVNNGADVNYQSKEGKSPLHMAAIHGRFTRSQILIQNGSEIDCADKFGNTPLHVAARYGHELLISTLMTNGADTARRGIHDMFPLHLAVLFGFSDCCRKLLSSGQLYSIVSSLSNEHVLSAGFDINTPDNLGRTCLHAAASGGNVECLNLLLSSGADLRRRDKFGRTPLHYAAANGSYQCAVTLVTAGAGVNEADCKGCSPLHYAAASDTYRRAEPHTPSSHDAEEDEPLKESRRKEAFFCLEFLLDNGADPSLRDRQGYTAVHYAAAYGNRQNLELLLEMSFNCLEDVESTIPVSPLHLAAYNGHCEALKTLAETLVNLDVRDHKGRTALFLATERGSTECVEVLTAHGASALIKERKRKWTPLHAAAASGHTDSLHLLIDSGERADITDVMDAYGQTPLMLAIMNGHVDCVHLLLEKGSTADAADLRGRTALHRGAVTGCEDCLAALLDHDAFVLCRDFKGRTPIHLASACGHTAVLRTLLQAALSTDPLDAGVDYSGYSPMHWASYTGHEDCLELLLEHSPFSYLEGNPFTPLHCAVINNQDSTTEMLLGALGAKIVNSRDAKGRTPLHAAAFADNVSGLRMLLQHQAEVNATDHTGRTALMTAAENGQTAAVEFLLYRGKADLTVLDENKNTALHLACSKGHEKCALMILAETQDLGLINATNSALQMPLHIAARNGLASVVQALLSHGATVLAVDEEGHTPALACAPNKDVADCLALILSTMKPFPPKDAVSPFSFSLLKNCSIAAAKTVGGCGALPHGASCPYSQERPGAIGLDGCYSE

SEQ ID NO: 5301 - protein, 343 aa, Homo sapiens
  Payload ID: 1154;
  Gene Symbol: ANKRD53;
  Gene Name: ankyrin repeat domain 53;
  Uniprot ID:  Q8N9V6;
  ENSP ID: ENSP00000272421
MASAGSTARRAGSGSWHSERGEGRGARPQPTPSGSMQQANKVSLKATWTDAESKQPSQPLPDLADHLSAQATALARPRRPASLTPPRADPSPSKESDQTAIDQTAIGSYYQLFAAAVGNVEWLRFCLNQSLREIPTDDKGFTAIHFAAQWGKLACLQVLVEEYKFPVDLLTNNSQTPLHLVIHRDNTTVALPCIYYLLEKGADLNAQTCNGSTPLHLAARDGLLDCVKVLVQSGANVHAQDAMGYKPIDFCKIWNHRACARFLKDAMWKKDKKDFAREMTKMKMFKSQLTLMEHNYLIEYQGQGCSVHFPFAFSPITPETLLWQDISLLSDCGFLWRRRELSF

SEQ ID NO: 5302 - protein, 530 aa, Homo sapiens
  Payload ID: 1154;
  Gene Symbol: ANKRD53;
  Gene Name: ankyrin repeat domain 53;
  Uniprot ID:  Q8N9V6;
  ENSP ID: ENSP00000353796
MASAGSTARRAGSGSWHSERGEGRGARPQPTPSGSMQQANKVSLKATWTDAESKQPSQPLPDLADHLSAQATALARPRRPASLTPPRADPSPSKESDQTAIDQTAIGSYYQLFAAAVGNVEWLRFCLNQSLREIPTDDKGFTAIHFAAQWGKLACLQVLVEEYKFPVDLLTNNSQTPLHLVIHRDNTTVALPCIYYLLEKGADLNAQTCNGSTPLHLAARDGLLDCVKVLVQSGANVHAQDAMGYKPIDFCKIWNHRACARFLKDAMWKKDKKDFAREMTKMKMFKSQLTLMEHNYLIEYQKEHKILREAAIRKWLHGKLHPGHSLVSNTKQARATALSKTPEQRESQRSRSFHPSVDARLQCIPQPTEMPKPIYRKPTVKRPTMWNVSNNPARPPTTQISHSQGIRLGVHPDPTPEHDFSSFLEVRPDGHGGARLHTVDGHWVAPVPRLPFEVLLRMLYPRVWPYRMKVPQGFYPISMREVPRKRHLGDNTFWTDTLAMNLRDTFDEAFLAAVRSHQGLPTLPSPQTNP

SEQ ID NO: 5303 - protein, 254 aa, Homo sapiens
  Payload ID: 1154;
  Gene Symbol: ANKRD53;
  Gene Name: ankyrin repeat domain 53;
  ENSP ID: ENSP00000388883
MASAGSTARRAGSGSWHSERGEGRGARPQPTPSGSMQQANKVSLKATWTDAESKQPSPSKESDQTAIDQTAIGSYYQLFAAAVGNVEWLRFCLNQSLREIPTDDKGFTAIHFAAQWGKLACLQVLVEEYKFPVDLLTNNSQTPLHLVIHRDNTTVALPCIYYLLEKGADLNAFLKDAMWKKDKKDFAREMTKMKMFKSQLTLMEHNYLIEYQGQGCSVHFPFAFSPITPETLLWQDISLLSDCGFLWRRRELSF

SEQ ID NO: 5304 - protein, 496 aa, Homo sapiens
  Payload ID: 1154;
  Gene Symbol: ANKRD53;
  Gene Name: ankyrin repeat domain 53;
  ENSP ID: ENSP00000407004
MASAGSTARRAGSGSWHSERGEGRGARPQPTPSGSMQQANKVSLKATWTDAESKQPSPSKESDQTAIDQTAIGSYYQLFAAAVGNVEWLRFCLNQSLREIPTDDKGFTAIHFAAQWGKLACLQVLVEEYKFPVDLLTNNSQTPLHLVIHRDNTTVALPCIYYLLEKGADLNAQTCNGSTPLHLAARDGLLDCVKVLVQSGANVHAQDAMGYKPIDFCKIWNHRACARFLKDAMWKKDKKDFAREMTKMKMFKSQLTLMEHNYLIEYQKEHKILREAAIRKWLHGKLHPGHSLVSNTKQARATALSKTPEQRESQRSRSFHPSVDARLQCIPQPTEMPKPIYRKPTVKRPTMWNVSNNPARPPTTQISHSQGIRLGVHPDPTPEHDFSSFLEVRPDGHGGARLHTVDGHWVAPVPRLPFEVLLRMLYPRVWPYRMKVPQGFYPISMREVPRKRHLGDNTFWTDTLAMNLRDTFDEAFLAAVRSHQGLPTLPSPQTNP

SEQ ID NO: 5305 - protein, 300 aa, Homo sapiens
  Payload ID: 1155;
  Gene Symbol: ANKRD54;
  Gene Name: ankyrin repeat domain 54;
  Uniprot ID:  Q6NXT1;
  ENSP ID: ENSP00000215941
MAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHALKRLRDSANANDVETVQQLLEDGADPCAADDKGRTALHFASCNGNDQIVQLLLDHGADPNQRDGLGNTPLHLAACTNHVPVITTLLRGGARVDALDRAGRTPLHLAKSKLNILQEGHAQCLEAVRLEVKQIIHMLREYLERLGQHEQRERLDDLCTRLQMTSTKEQVDEVTDLLASFTSLSLQMQSMEKR

SEQ ID NO: 5306 - protein, 180 aa, Homo sapiens
  Payload ID: 1155;
  Gene Symbol: ANKRD54;
  Gene Name: ankyrin repeat domain 54;
  ENSP ID: ENSP00000384392
MPMMWKQQLLEDGADPCAADDKGRTALHFASCNGNDQIVQLLLDHGADPNQRDGLGNTPLHLAACTNHVPVITTLLRGGARVDALDRAGRTPLHLAKSKLNILQEGHAQCLEAVRLEVKQIIHMLREYLERLGQHEQRERLDDLCTRLQMTSTKEQVDEVTDLLASFTSLSLQMQSMEKR

SEQ ID NO: 5307 - protein, 156 aa, Homo sapiens
  Payload ID: 1155;
  Gene Symbol: ANKRD54;
  Gene Name: ankyrin repeat domain 54;
  ENSP ID: ENSP00000385180
MARIPVQLMTRAAQLYTLPHAMAMTRLLLLDHGADPNQRDGLGNTPLHLAACTNHVPVITTLLRGGARVDALDRAGRTPLHLAKSKLNILQEGHAQCLEAVRLEVKQIIHMLREYLERLGQHEQRERLDDLCTRLQMTSTKEQVDEVTDLLASFTS

SEQ ID NO: 5308 - protein, 216 aa, Homo sapiens
  Payload ID: 1155;
  Gene Symbol: ANKRD54;
  Gene Name: ankyrin repeat domain 54;
  ENSP ID: ENSP00000387507
MAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHALKRLRDSANANDVETVQQLLEDGADPCAADDKGRTALHFASCNGNDQIVQLLLDHGADPNQRDGLGNTPLHLAACTNHVPVITTLLRGAGTCRGPCRCPGPSWSHT

SEQ ID NO: 5309 - protein, 178 aa, Homo sapiens
  Payload ID: 1155;
  Gene Symbol: ANKRD54;
  Gene Name: ankyrin repeat domain 54;
  ENSP ID: ENSP00000391744
  MOD_RES (1)..(1): Any amino acid
XRLRRPGPRGAVAMAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHALKRLRDSANANDVETVQQLLEDGADPCAADDKGRTALHFASCNGNDQIAAPGPWC

SEQ ID NO: 5310 - protein, 90 aa, Homo sapiens
  Payload ID: 1155;
  Gene Symbol: ANKRD54;
  Gene Name: ankyrin repeat domain 54;
  ENSP ID: ENSP00000393035
MARIPVQLMTRAAQLYTLPHAMAMTRLLLLDHGADPNQRDGLGNTPLHLAACTNHVPVITTLLRGGARVDALDRAGRTPLHLAKSKLNIL

SEQ ID NO: 5311 - protein, 284 aa, Homo sapiens
  Payload ID: 1155;
  Gene Symbol: ANKRD54;
  Gene Name: ankyrin repeat domain 54;
  ENSP ID: ENSP00000405782
MAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHVQQLLEDGADPCAADDKGRTALHFASCNGNDQIVQLLLDHGADPNQRDGLGNTPLHLAACTNHVPVITTLLRGGARVDALDRAGRTPLHLAKSKLNILQEGHAQCLEAVRLEVKQIIHMLREYLERLGQHEQRERLDDLCTRLQMTSTKEQVDEVTDLLASFTSLSLQMQSMEKR

SEQ ID NO: 5312 - protein, 208 aa, Homo sapiens
  Payload ID: 1155;
  Gene Symbol: ANKRD54;
  Gene Name: ankyrin repeat domain 54;
  ENSP ID: ENSP00000412534
  MOD_RES (1)..(1): Any amino acid
XRDELRCKIPAGRLRRAARPHRRLGPTGKEVHALKRLRDSANANDVETVQQLLEDGADPCAADDKGRTALHFASCNGNDQIVQLLLDHGADPNQRDGLGNTPLHLECSPQLVPAGARVDALDRAGRTPLHLAKSKLNILQEGHAQCLEAVRLEVKQIIHMLREYLERLGQHEQRERLDDLCTRLQMTSTKEQVDEVTDLLASFTSLSL

SEQ ID NO: 5313 - protein, 107 aa, Homo sapiens
  Payload ID: 1155;
  Gene Symbol: ANKRD54;
  Gene Name: ankyrin repeat domain 54;
  ENSP ID: ENSP00000477088
MPMMWKQCSCSWTMVLILTSEMGWGTRHCTWRPAPTTFLSSPHCYEEIIHMLREYLERLGQHEQRERLDDLCTRLQMTSTKEQVDEVTDLLASFTSLSLQMQSMEKR

SEQ ID NO: 5314 - protein, 614 aa, Homo sapiens
  Payload ID: 1156;
  Gene Symbol: ANKRD55;
  Gene Name: ankyrin repeat domain 55;
  Uniprot ID:  Q3KP44;
  ENSP ID: ENSP00000342295
MMRQATMDFSTPSVFDQQRGDSSEEVDLTMVYQAASNGDVNALTAVIREDPSILECCDSEGCTPLMHAVSGRQADTVKLLLKMGANINMQDAYGRTSLCLATYLGWLEGCVSLLRNGAKHNIPDKNGRLPLHAATAEPDMRLLTVLLQQSNISEINHQDNEGMTPLHWAAFHNQPQHTQMLLKKGADPTLVDKDFKTALHWAVQSGNRILCSIILSHHQGPSIINYDDESGKTCVHIAAAAGFSDIIHELARVPECNLQALDVDDRTPLHWAAAAGKAECVQSLLELGMDSNLRDINESTPLAYALYCGHTACVKLLSQESRTEPTRPPPSQSSRPQKKERRFNVLNQIFCKNKKEEQRAHQKDPSRDRYREEDTSEVNDIITTFDSIVGTNCQEQPGDQVAMVEFKKKTSDNSKYLLPEKKPLARKGLPPIRTQSLPPITLGNNFLTASHRATSHAGLSSAPHHMAQRSQKSRSEQDLLNNRTGCQMLLDNPWKSDSNQVFSYKVWTVSSSDKLLDRLLSVRPGHQEVSVPPHLRHLHNPSSGQNFQHLSPNRHKIRDLPFTRNNLAPLPDQKFLSGEPLRTNRVLPAIPSQRRHSTAAEESEHSANPTSDEN

SEQ ID NO: 5315 - protein, 178 aa, Homo sapiens
  Payload ID: 1156;
  Gene Symbol: ANKRD55;
  Gene Name: ankyrin repeat domain 55;
  ENSP ID: ENSP00000423507
MVYQAASNGDVNALTAVIREDPSILECCDSEGCTPLMHAVSGRQADTVKLLLKMGANINMQDAYGRTSLCLATYLGWLEGCVSLLRNGAKHNIPDKNGRLPLHAATAEPDMRLLTVLLQQSNISEINHQDNEGMTPLHWAAFHNQPQHTQMLLKKGADPTLVDKDFKTALHWAVQVRN

SEQ ID NO: 5316 - protein, 571 aa, Homo sapiens
  Payload ID: 1156;
  Gene Symbol: ANKRD55;
  Gene Name: ankyrin repeat domain 55;
  ENSP ID: ENSP00000424230
MMRQATMDFSTPSVFDQQRGDSSEEVDLTMVYQAASNGDVNALTAVIREDPSILECCDSEGCTPLMHAVSGRQADTVKLLLKMGANINMQDAYGRTSLCLATYLGWLEGCVSLLRNGAKHNIPDKNGRLPLHAATAEPDMRLLTVLLQQSNISEINHQDNESGNRILCSIILSHHQGPSIINYDDESGKTCVHIAAAAGFSDIIHELARVPECNLQALDVDDRTPLHWAAAAGKAECVQSLLELGMDSNLRDINESTPLAYALYCGHTACVKLLSQESRTEPTRPPPSQSSRPQKKERRFNVLNQIFCKNKKEEQRAHQKDPSRDRYREEDTSEVNDIITTFDSIVGTNCQEQPGDQVAMVEFKKKTSDNSKYLLPEKKPLARKGLPPIRTQSLPPITLGNNFLTASHRATSHAGLSSAPHHMAQRSQKSRSEQDLLNNRTGCQMLLDNPWKSDSNQVFSYKVWTVSSSDKLLDRLLSVRPGHQEVSVPPHLRHLHNPSSGQNFQHLSPNRHKIRDLPFTRNNLAPLPDQKFLSGEPLRTNRVLPAIPSQRRHSTAAEESEHSANPTSDEN

SEQ ID NO: 5317 - protein, 326 aa, Homo sapiens
  Payload ID: 1156;
  Gene Symbol: ANKRD55;
  Gene Name: ankyrin repeat domain 55;
  Uniprot ID:  Q3KP44;
  ENSP ID: ENSP00000429421
MDSNLRDINESTPLAYALYCGHTACVKLLSQESRTEPTRPPPSQSSRPQKKERRFNVLNQIFCKNKKEEQRAHQKDPSRDRYREEDTSEVNDIITTFDSIVGTNCQEQPGDQVAMVEFKKKTSDNSKYLLPEKKPLARKGLPPIRTQSLPPITLGNNFLTASHRATSHAGLSSAPHHMAQRSQKSRSEQDLLNNRTGCQMLLDNPWKSDSNQVFSYKVWTVSSSDKLLDRLLSVRPGHQEVSVPPHLRHLHNPSSGQNFQHLSPNRHKIRDLPFTRNNLAPLPDQKFLSGEPLRTNRVLPAIPSQRRHSTAAEESEHSANPTSDEN

SEQ ID NO: 5318 - protein, 727 aa, Homo sapiens
  Payload ID: 1157;
  Gene Symbol: ANKRD6;
  Gene Name: ankyrin repeat domain 6;
  Uniprot ID:  Q9Y2G4;
  ENSP ID: ENSP00000345767
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLIKAGANVLAKNKAGNTALHLACQNSHSQSTRVLLLAGSRADLKNNAGDTCLHVAARYNHLSIIRLLLTAFCSVHEKNQAGDTALHVAAALNHKKVAKILLEAGADTTIVNNAGQTPLETARYHNNPEVALLLTKAPQVLRFSRGRSLRKKRERLKEERRAQSVPRDEVAQSKGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQISLVDELKTWCMLKIQNLEQKLSGDSRACRAKSTPSTCESSTGVDQLVVTAGPAAASDSSPPVVRPKEKALNSTATQRLQQELSSSDCTGSRLRNVKVQTALLPMNEAARSDQQAGPCVNRGTQTKKSGKSGPTRHRAQQPAASSTCGQPPPATGSEQTGPHIRDTSQALELTQYFFEAVSTQMEKWYERKIEEARSQANQKAQQDKATLKEHIKSLEEELAKLRTRVQKEN

SEQ ID NO: 5319 - protein, 692 aa, Homo sapiens
  Payload ID: 1157;
  Gene Symbol: ANKRD6;
  Gene Name: ankyrin repeat domain 6;
  Uniprot ID:  Q9Y2G4;
  ENSP ID: ENSP00000358416
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLIKAGANVLAKNKAGNTALHLACQNSHSQSTRVLLLAGSRADLKNNAGDTCLHVAARYNHLSIIRLLLTAFCSVHEKNQAGDTALHVAAALNHKKVAKILLEAGADTTIVNNAGQTPLETARYHNNPEVALLLTKAPQGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQISLVDELKTWCMLKIQNLEQKLSGDSRACRAKSTPSTCESSTGVDQLVVTAGPAAASDSSPPVVRPKEKALNSTATQRLQQELSSSDCTGSRLRNVKVQTALLPMNEAARSDQQAGPCVNRGTQTKKSGKSGPTRHRAQQPAASSTCGQPPPATGSEQTGPHIRDTSQALELTQYFFEAVSTQMEKWYERKIEEARSQANQKAQQDKATLKEHIKSLEEELAKLRTRVQKEN

SEQ ID NO: 5320 - protein, 722 aa, Homo sapiens
  Payload ID: 1157;
  Gene Symbol: ANKRD6;
  Gene Name: ankyrin repeat domain 6;
  Uniprot ID:  Q9Y2G4;
  ENSP ID: ENSP00000396771
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLIKAGANVLAKNKAGNTALHLACQNSHSQSTRVLLLAGSRADLKNNAGDTCLHVAARYNHLSIIRLLLTAFCSVHEKNQAGDTALHVAAALNHKKVAKILLEAGADTTIVNNAGQTPLETARYHNNPEVALLLTKAPQVLRFSRGRSLRKKRERLKEERRAQSVPRDEVAQSKGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQISLVDELKTWCMLKIQNLEQKLSGDSRACRAKSTPSTCVDQLVVTAGPAAASDSSPPVVRPKEKALNSTATQRLQQELSSSDCTGSRLRNVKVQTALLPMNEAARSDQQAGPCVNRGTQTKKSGKSGPTRHRAQQPAASSTCGQPPPATGSEQTGPHIRDTSQALELTQYFFEAVSTQMEKWYERKIEEARSQANQKAQQDKATLKEHIKSLEEELAKLRTRVQKEN

SEQ ID NO: 5321 - protein, 118 aa, Homo sapiens
  Payload ID: 1157;
  Gene Symbol: ANKRD6;
  Gene Name: ankyrin repeat domain 6;
  ENSP ID: ENSP00000428309
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWH

SEQ ID NO: 5322 - protein, 102 aa, Homo sapiens
  Payload ID: 1157;
  Gene Symbol: ANKRD6;
  Gene Name: ankyrin repeat domain 6;
  ENSP ID: ENSP00000428377
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALD

SEQ ID NO: 5323 - protein, 230 aa, Homo sapiens
  Payload ID: 1157;
  Gene Symbol: ANKRD6;
  Gene Name: ankyrin repeat domain 6;
  ENSP ID: ENSP00000429235
MSQQDAVAALSERLLVAAYKGQTENVVQLINKGARVAVTKGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKH

SEQ ID NO: 5324 - protein, 54 aa, Homo sapiens
  Payload ID: 1157;
  Gene Symbol: ANKRD6;
  Gene Name: ankyrin repeat domain 6;
  ENSP ID: ENSP00000429337
MSQQDAVAALSERLLVAAYKGQTENVVQLINKGARVAVTKGDQTALHRATVVGN

SEQ ID NO: 5325 - protein, 175 aa, Homo sapiens
  Payload ID: 1157;
  Gene Symbol: ANKRD6;
  Gene Name: ankyrin repeat domain 6;
  ENSP ID: ENSP00000429431
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLIKAGANVLAKNKAGNTALHLACQNSHSQSTRVLLLAGSRADLKNNAGD

SEQ ID NO: 5326 - protein, 76 aa, Homo sapiens
  Payload ID: 1157;
  Gene Symbol: ANKRD6;
  Gene Name: ankyrin repeat domain 6;
  ENSP ID: ENSP00000429456
  MOD_RES (1)..(1): Any amino acid
XGDTCLHVAARYNHLSIIRLLLTAFCSVHEKNQAGDTALHVAAALNHKKVAKILLEAGADTTIVNNLPDCSEHNLA

SEQ ID NO: 5327 - protein, 152 aa, Homo sapiens
  Payload ID: 1157;
  Gene Symbol: ANKRD6;
  Gene Name: ankyrin repeat domain 6;
  ENSP ID: ENSP00000429531
  MOD_RES (1)..(1): Any amino acid
XHRCSSPPPPHEFRAYQLYTLYRGKDGKVMQMRVLDKLMVERLSAERTECLNRLQQHSDTEKHEGEKRQISLVDELKTWCMLKIQNLEQKLSGDSRACRAKSTPSTCESSTGVDQLVVTAGPAAASDSSPPVVRPKEKALNSTATQRLQQEL

SEQ ID NO: 5328 - protein, 663 aa, Homo sapiens
  Payload ID: 1157;
  Gene Symbol: ANKRD6;
  Gene Name: ankyrin repeat domain 6;
  Uniprot ID:  Q9Y2G4;
  ENSP ID: ENSP00000429782
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKAGNTALHLACQNSHSQSTRVLLLAGSRADLKNNAGDTCLHVAARYNHLSIIRLLLTAFCSVHEKNQAGDTALHVAAALNHKKVAKILLEAGADTTIVNNVLRFSRGRSLRKKRERLKEERRAQSVPRDEVAQSKGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQISLVDELKTWCMLKIQNLEQKLSGDSRACRAKSTPSTCVDQLVVTAGPAAASDSSPPVVRPKEKALNSTATQRLQQELSSSDCTGSRLRNVKVQTALLPMNEAARSDQQAGPCVNRGTQTKKSGKSGPTRHRAQQPAASSTCGQPPPATGSEQTGPHIRDTSQALELTQYFFEAVSTQMEKWYERKIEEARSQANQKAQQDKATLKEHIKSLEEELAKLRTRVQKEN

SEQ ID NO: 5329 - protein, 130 aa, Homo sapiens
  Payload ID: 1157;
  Gene Symbol: ANKRD6;
  Gene Name: ankyrin repeat domain 6;
  ENSP ID: ENSP00000430452
KLGQMENKTQHQMRVLDKLMVERLSAERTECLNRLQQHSDTEKHEGEKRQISLVDELKTWCMLKIQNLEQKLSGDSRACRAKSTPSTCESSTGNPHTESPFVQKEHDQQLLYSPALKGSTYARAVGNTGW

SEQ ID NO: 5330 - protein, 307 aa, Homo sapiens
  Payload ID: 1157;
  Gene Symbol: ANKRD6;
  Gene Name: ankyrin repeat domain 6;
  ENSP ID: ENSP00000430954
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLIKAGANVLAKNKAGNTALHLACQNSHSQSTRVLLLAGSRADLKNNAGDTCLHVAARYNHLSIIRLLLTAFCSVHEKNQAGDTALHVAAALNHKKVAKILLEAGADTTIVNNAGQTPLETARYHNNPEVALLLTKAPQVGFTALSMVLIMRDYKVVGTPGCNLLKPLQTNLNMECNQAVEV

SEQ ID NO: 5331 - protein, 727 aa, Homo sapiens; identical to SEQ ID NO: 5318
  Payload ID: 1157;
  Gene Symbol: ANKRD6;
  Gene Name: ankyrin repeat domain 6;
  Uniprot ID:  Q9Y2G4;
  ENSP ID: ENSP00000430985

SEQ ID NO: 5332 - protein, 80 aa, Homo sapiens
  Payload ID: 1157;
  Gene Symbol: ANKRD6;
  Gene Name: ankyrin repeat domain 6;
  ENSP ID: ENSP00000431061
MSQQDAVAALSERLLVAAYKGQTENVVQLINKGARVAVTKHGRTPLHLAANKGHLPVVQILLKAGCDLDVQDDGDQTALH

SEQ ID NO: 5333 - protein, 345 aa, Homo sapiens
  Payload ID: 1158;
  Gene Symbol: ANKRD60;
  Gene Name: ankyrin repeat domain 60;
  Uniprot ID:  Q9BZ19;
  ENSP ID: ENSP00000396747
MTRGRAWGMRRAAAGAGGARAAGPTGGASRLHPNAGRRSGARAGAQGCGGPRVGSADSRALPAQPLACARGRSQRLVCDPKAASALPDLAPDVFVLRVRLEETGEMFRVANCRGDMTVRELKEELDLMVGIPFNLQRLQYLDEGVLMDDTTLKFHDVVPGGIISLCIWHHDGWTELVLAAVEGDPSKLSCLGLTEDSFYRTANSEHFEGEKWKHWTSQRAFVALYVASHRGHFDAVQYLLEHGASCLSRSPLGRTPLHVAAAMGRSDCIILLLQHGASIHDRDAKGETPISIAHRLNHTLSERQMVLLHRIAKSGIRDLNDLVMKNALQRVKSGFRSEKMTMTPH

SEQ ID NO: 5334 - protein, 418 aa, Homo sapiens
  Payload ID: 1159;
  Gene Symbol: ANKRD61;
  Gene Name: ankyrin repeat domain 61;
  Uniprot ID:  A6NGH8;
  ENSP ID: ENSP00000386502
MGNITRKGSRDLVVDSAKSLEDGPSAALHSKLYEAIMREDCTTIEVLLRNHPVNQPITILPNSASNRLLLTQPTESIIPIHLAAKYHKAQSLLCLLRHGADPEVRDTTGLTTLNLMLLHWPVTSTTWAKPGNRTHRILTDIQNSSITCLRILCAHGAQVNTQGEISNKRSPLHLAIAYGCYPVLSILTQNGADVNAINEASMTPLHMAANMLNKEMMETLIAYGANVNCAVSSTGNTPLKLAVCTASSKAGRLLGAGVSCIRLLLTHGAKVNAQDYKGQTAIHEACFGGREAIINLLLEFEANVNILTRNGESPIYMYLQRSCNVRDTALLARLLYHTYPLRMTNNQGILPAGIMLPEFRLLRDTLIKQSQKPLSLQGICKRNIRNIYGEKYKQHLKQFLPVTIWNSVYCCYDLAYTS

SEQ ID NO: 5335 - protein, 917 aa, Homo sapiens
  Payload ID: 1160;
  Gene Symbol: ANKRD62;
  Gene Name: ankyrin repeat domain 62;
  Uniprot ID:  A6NC57;
  ENSP ID: ENSP00000467740
MEVRGSFLAACRRRMATWRKNRDKDGFSNPGYRVRQKDLGMIHKAAIAGDVNKVMESILLRLNDLNDRDKKNRTALLLACAHGRPGVVADLVARKCQLNLTDSENRTALIKAVQCQEEVCASILLEHGANPNVRDMYGNTALHYAIDNENISMARKLLAYGADIEARSQDGHTSLLLAVNRKKEQMVAFLLKKKPDLTAIDNFGRTALILAARNGSTSVVYQLLQHNIDVFCQDISGWTAEDYAVASKFQAIRGMISEYKANKRCKSLQNSNSEQDLEMTSEGEQERLEGCESSQPQVEEKMKKCRNKKMEVSRNVHADDSDNYNDDVDELIHKIKNRKPDNHQSPGKENGEFDRLARKTSNEKSKVKSQIYFTDDLNDISGSSEKTSEDDELPYSDDENFMLLIEQSGMECKDFVSLSKSKNATAACGRSIEDQKCYCERLKVKFQKMKNNISVLQKVLSETDKTKSQSEHQNLQGKKKLCNLRFILQQQEEERIKAEELYEKDIEELKIMEEQYRTQTEVKKQSKLTLKSLEVELKTVRSNSNQNFHTHERERDLWQENHLMRDEIARLRLEIDTIKHQNQETENKYFKDIEIIKENNEDLEKTLKRNEEALTKTITRYSKELNVLMDENTMLNSELQKEKQSMSRLETEMESYRCRLAAALCDHDQRQSSKRDLQLAFQSTVNEWCHLQEDTNSHIQILSQQLSKAESTSSGLETELHYEREALKEKTLHIEHMQGVLSRTQRRLEDIEHMYQNDQPILEKYVRKQQSVEDGLFQLQSQNLLYQQQCNDARKKADNQEKTIINIQVKCEDTVEKLQAECRKLEENNKGLMKECTLLKERQCQYEKEKEEREVVRRQLQREVDDALNKQLLLEAMLEISSERRINLEDEAQSLKKKLGQMRSQVCMKLSMSTVTL

SEQ ID NO: 5336 - protein, 380 aa, Homo sapiens
  Payload ID: 1161;
  Gene Symbol: ANKRD63;
  Gene Name: ankyrin repeat domain 63;
  Uniprot ID:  C9JTQ0;
  ENSP ID: ENSP00000399547
MLKPKDLCPRAGTRTFLEAMQAGKVHLARFVLDALDRSIIDCRAEQGRTPLMVAVGLPDPALRARFVRLLLEQGAAVNLRDERGRTALSLACERGHLDAVQLLVQFSGDPEAADSAGNSPVMWAAACGHGAVLEFLVRSFRRLGLRLDRTNRAGLTALQLAAARGHGTCVQALTGPWGRAAAAAAARGSNSDSPPGRPAPAASPEHRRPSPRRLPRPLLARFARAAGGHGGEAGSAGKNSGRHRAQGSERPELGRSMSLALGAVTEEEAARLRAGALMALPNSPQSSGTGRWRSQEVLEGAPPTLAQAPIGLSPHPEGGPGSGRLGLRRRSTAPDIPSLVGEAPGPESGPELEANALSVSVPGPNPWQAGTEAVVLRAQR

SEQ ID NO: 5337 - protein, 174 aa, Homo sapiens
  Payload ID: 1162;
  Gene Symbol: ANKRD65;
  Gene Name: ankyrin repeat domain 65;
  Uniprot ID:  E5RJM6;
  ENSP ID: ENSP00000428201
MDSQRPEPREEEEEEQELRWMELDSEEALGTRTEGPSVVQGWGHLLQAVWRGPAGLVTQLLRQGASVEERTLRCCWATGQTQASGTGMAALRCTGLPPEDTCLPSSCWSPRGPRWMRGTPWASHPCITPLGKATWRLPAACWTGVPRWMLPAGSERPPYTWLQSEGMGLPWGFC

SEQ ID NO: 5338 - protein, 174 aa, Homo sapiens; identical to SEQ ID NO: 5337
  Payload ID: 1162;
  Gene Symbol: ANKRD65;
  Gene Name: ankyrin repeat domain 65;
  Uniprot ID:  E5RJM6;
  ENSP ID: ENSP00000428419

SEQ ID NO: 5339 - protein, 65 aa, Homo sapiens
  Payload ID: 1162;
  Gene Symbol: ANKRD65;
  Gene Name: ankyrin repeat domain 65;
  Uniprot ID:  E5RJM6;
  ENSP ID: ENSP00000429035
MDSQRPEPREEEEEEQELRWMELDSEEALGTRTEGPSVVQGWGHLLQAVWRGPAGLVTQLLRQGH

SEQ ID NO: 5340 - protein, 399 aa, Homo sapiens
  Payload ID: 1162;
  Gene Symbol: ANKRD65;
  Gene Name: ankyrin repeat domain 65;
  Uniprot ID:  E5RJM6;
  ENSP ID: ENSP00000445688
MDSQRPEPREEEEEEQELRWMELDSEEALGTRTEGPSVVQGWGHLLQAVWRGPAGLVTQLLRQGASVEERDHAGRTPLHLAVLRGHAPLVRLLLQRGAPVGAVDRAGRTALHEAAWHGHSRVAELLLQRGASAAARSGTGLTPLHWAAALGHTLLAARLLEAPGPGPAAAEAEDARGWTAAHWAAAGGRLAVLELLAAGGAGLDGALLVAAAAGRGAALRFLLARGARVDARDGAGATALGLAAALGRSQDIEVLLGHGADPGIRDRHGRSALHRAAARGHLLAVQLLVTQGAEVDARDTLGLTPLHHASREGHVEVAGCLLDRGAQVDATGWLRKTPLHLAAERGHGPTVGLLLSRGASPTLRTQWAEVAQMPEGDLPQALPELGGGEKECEGIESTG

SEQ ID NO: 5341 - protein, 399 aa, Homo sapiens; identical to SEQ ID NO: 5340
  Payload ID: 1162;
  Gene Symbol: ANKRD65;
  Gene Name: ankyrin repeat domain 65;
  Uniprot ID:  E5RJM6;
  ENSP ID: ENSP00000482314

SEQ ID NO: 5342 - protein, 251 aa, Homo sapiens
  Payload ID: 1163;
  Gene Symbol: ANKRD66;
  Gene Name: ankyrin repeat domain 66;
  Uniprot ID:  B4E2M5;
  ENSP ID: ENSP00000454770
MDTTLRMVRTACQHRAPQISHKTGCSHISMHSPGGLTTTKMAGPLPRVSDSLFSAMELAKMSDMTKLHQAVAAGDYSLVKKILKKGLCDPNYKDVDWNDRTPLHWAAIKGQMEVIRLLIEYGARPCLVTSVGWTPAHFAAEAGHLNILKTLHALHAAIDAPDFFGDTPKRIAQIYGQKACVAFLEKAEPECQDHRCAAQQKGLPLDERDEDWDAKKRELELSLPSLNQNMNKKNKKSRGPTRPSNTKGRRV

SEQ ID NO: 5343 - protein, 73 aa, Homo sapiens
  Payload ID: 1163;
  Gene Symbol: ANKRD66;
  Gene Name: ankyrin repeat domain 66;
  ENSP ID: ENSP00000457147
  MOD_RES (1)..(1): Any amino acid
XIEYGARPCLVTSVGWTPAHFAAEAGHLNILKTLHALHAAIDAPDFFGDTPKRIAQIYGQKACVAFLEKGIEF

SEQ ID NO: 5344 - protein, 254 aa, Homo sapiens
  Payload ID: 1164;
  Gene Symbol: ANKRD7;
  Gene Name: ankyrin repeat domain 7;
  Uniprot ID:  Q92527;
  ENSP ID: ENSP00000265224
MNKLFSFWKRKNETRSQGYNLREKDLKKLHRAASVGDLKKLKEYLQIKKYDVNMQDKKYRTPLHLACANGHTDVVLFLIEQQCKINVRDSENKSPLIKAVQCQNEDCATILLNFGADPDLRDIRYNTVLHYAVCGQSLSLVEKLLEYEADLEAKNKDGYTPLLVAVINNNPKMVKFLLEKGADVNASDNYQRTALILAVSGEPPCLVKLLLQQGVELCYEGIVDSQLRNMFISMVLLHRYPQFTASHGKKKHAK

SEQ ID NO: 5345 - protein, 263 aa, Homo sapiens
  Payload ID: 1164;
  Gene Symbol: ANKRD7;
  Gene Name: ankyrin repeat domain 7;
  ENSP ID: ENSP00000395595
MNKLFSFWKRKNETRSQGYNLREKDLKKLHRAASVGDLKKLKEYLQIKKYDVNMQDKKYRTPLHLACANGHTDVVLFLIEQQCKINVRDSENKSPLIKAVQCQNEDCATILLNFGADPDLRDIRYNTVLHYAVCGQSLSLVEKLLEYEADLEAKNKDGYTPLLVAVINNNPKMVKFLLEKGADVNASDNYQRTALILAVSGEPPCLVKLLLQQGVELCYEGIVDSQLRNMFISMVLLHTHNSLRAMERRNMLNRHLILGTTCD

SEQ ID NO: 5346 - protein, 104 aa, Homo sapiens
  Payload ID: 1164;
  Gene Symbol: ANKRD7;
  Gene Name: ankyrin repeat domain 7;
  ENSP ID: ENSP00000417353
MNKLFSFWKRKNETRSQGYNLREKDLKKLHRAASVGDLKKLKEYLQIKKYDVNMQDKKYSVVQSSRWLLSYTTPLNDFIRTPLHLACANGHTDVVLFLIEQQCK

SEQ ID NO: 5347 - protein, 150 aa, Homo sapiens
  Payload ID: 1164;
  Gene Symbol: ANKRD7;
  Gene Name: ankyrin repeat domain 7;
  ENSP ID: ENSP00000482875
MRIVTILLNFGADPDLRDIRYNTVLHYAVCGQSLSLVEKLLEYEADLEAKNKDGYTPLLVAVINNNPKMVKFLLEKGADVNASDNYQRTALILAVSGEPPCLVKLLLQQGVELCYEGIVDSQLRNMFISMVLLHRYPQFTASHGKKKHAK

SEQ ID NO: 5348 - protein, 82 aa, Homo sapiens
  Payload ID: 1164;
  Gene Symbol: ANKRD7;
  Gene Name: ankyrin repeat domain 7;
  ENSP ID: ENSP00000489121
MVKFLLEKGADVNASDNYQRTALILAVSGEPPCLVKLLLQQGVELCYEGIVDSQLRNMFISMVLLHRYPQFTASHGKKKHAK

SEQ ID NO: 5349 - protein, 317 aa, Homo sapiens
  Payload ID: 1165;
  Gene Symbol: ANKRD9;
  Gene Name: ankyrin repeat domain 9;
  Uniprot ID:  Q96BM1;
  ENSP ID: ENSP00000286918
MPWDARRPGGGADGGPEASGAARSRAQKQCRKSSFAFYQAVRDLLPVWLLEDMRASEAFHWDERGRAAAYSPSEALLYALVHDHQAYAHYLLATFPRRALAPPSAGFRCCAAPGPHVALAVRYNRVGILRRILRTLRDFPAEERARVLDRRGCSRVEGGGTSLHVACELARPECLFLLLGHGASPGLRDGGGLTPLELLLRQLGRDAGATPSAAGAPASAPGEPRQRRLLLLDLLALYTPVGAAGSARQELLGDRPRWQRLLGEDKFQWLAGLAPPSLFARAMQVLVTAISPGRFPEALDELPLPPFLQPLDLTGKG

SEQ ID NO: 5350 - protein, 259 aa, Homo sapiens
  Payload ID: 1165;
  Gene Symbol: ANKRD9;
  Gene Name: ankyrin repeat domain 9;
  ENSP ID: ENSP00000453417
MPWDARRPGGGADGGPEASGAARSRAQKQCRKSSFAFYQAVRDLLPVWLLEDMRASEAFHWDERGRAAAYSPSEALLYALVHDHQAYAHYLLATFPRRALAPPSAGFRCCAAPGPHVALAVRYNRVGILRRILRTLRDFPAEERARVLDRRGCSRVEGGGTSLHVACELARPECLFLLLGHGASPGLRDGGGLTPLELLLRQLGRDAGATPSAAGAPASAPGEPRQRRLLLLDLLALYTPVGAAGSARQELLGDRPRWQ

SEQ ID NO: 5351 - protein, 317 aa, Homo sapiens; identical to SEQ ID NO: 5349
  Payload ID: 1165;
  Gene Symbol: ANKRD9;
  Gene Name: ankyrin repeat domain 9;
  Uniprot ID:  Q96BM1;
  ENSP ID: ENSP00000453650

SEQ ID NO: 5352 - protein, 105 aa, Homo sapiens
  Payload ID: 1165;
  Gene Symbol: ANKRD9;
  Gene Name: ankyrin repeat domain 9;
  ENSP ID: ENSP00000454080
MPWDARRPGGGADGGPEASGAARSRAQKQCRKSSFAFYQAVRDLLPVWLLEDMRASEAFHWDERGRAAAYSPSEALLYALVHDHQAYAHYLLATFPRRALAPPSA

SEQ ID NO: 5353 - protein, 317 aa, Homo sapiens; identical to SEQ ID NO: 5349
  Payload ID: 1165;
  Gene Symbol: ANKRD9;
  Gene Name: ankyrin repeat domain 9;
  Uniprot ID:  Q96BM1;
  ENSP ID: ENSP00000454100

SEQ ID NO: 5354 - protein, 313 aa, Homo sapiens
  Payload ID: 1166;
  Gene Symbol: ANKRA2;
  Gene Name: ankyrin repeat, family A (RFXANK-like), 2;
  Uniprot ID:  Q9H9E1;
  ENSP ID: ENSP00000296785
MDTSTNLDIGAQLIVEECPSTYSLTGMPDIKIEHPLDPNSEEGSAQGVAMGMKFILPNRFDMNVCSRFVKSLNEEDSKNIQDQVNSDLEVASVLFKAECNIHTSPSPGIQVRHVYTPSTTKHFSPIKQSTTLTNKHRGNEVSTTPLLANSLSVHQLAAQGEMLYLATRIEQENVINHTDEEGFTPLMWAAAHGQIAVVEFLLQNGADPQLLGKGRESALSLACSKGYTDIVKMLLDCGVDVNEYDWNGGTPLLYAVHGNHVKCVKMLLESGADPTIETDSGYNSMDLAVALGYRSVQQVIESHLLKLLQNIKE

SEQ ID NO: 5355 - protein, 177 aa, Homo sapiens
  Payload ID: 1166;
  Gene Symbol: ANKRA2;
  Gene Name: ankyrin repeat, family A (RFXANK-like), 2;
  ENSP ID: ENSP00000422643
MDTSTNLDIGAQLIVEECPSTYSLTGMPDIKIEHPLDPNSEEGSAQGVAMGMKFILPNRFDMNVCSRFVKSLNEEDSKNIQDQVNSDLEVASVLFKALSVHQLAAQGEMLYLATRIEQENVINHTDEEGFTPLMWAAAHGQIAVVEFLLQNGADPQLLGKGRESALSLACSKGYTDI

SEQ ID NO: 5356 - protein, 475 aa, Homo sapiens
  Payload ID: 1167;
  Gene Symbol: ASZ1;
  Gene Name: ankyrin repeat, SAM and basic leu zipper domain containing 1;
  Uniprot ID:  Q8WWH4;
  ENSP ID: ENSP00000284629
MAASALRGLPVAGGGESSESEDDGWEIGYLDRTSQKLKRLLPIEEKKEKFKKAMTIGDVSLVQELLDSGISVDSNFQYGWTPLMYAASVANAELVRVLLDRGANASFEKDKQSILITACSAHGSEEQILKCVELLLSRNADPNVACRRLMTPIMYAARDGHTQVVALLVAHGAEVNTQDENGYTALTWAARQGHKNIVLKLLELGANKMLQTKDGKMPSEIAKRNKHHEIFNLLSFTLNPLEGKLQQLTKEDTICKILTTDSDREKDHIFSSYTAFGDLEVFLHGLGLEHMTDLLKERDITLRHLLTMREDEFTKNGITSKDQQKILAALKELQVEEIQFGELSEETKLEISGDEFLNFLLKLNKQCGHLITAVQNVITELPVNSQKITLEWASPQNFTSVCEELVNNVEDLSEKVCKLKDLIQKLQNERENDPTHIQLREEVSTWNSRILKRTAITICGFGFLLFICKLTFQRK

SEQ ID NO: 5357 - protein, 148 aa, Homo sapiens
  Payload ID: 1167;
  Gene Symbol: ASZ1;
  Gene Name: ankyrin repeat, SAM and basic leu zipper domain containing 1;
  ENSP ID: ENSP00000389791
MAASALRGLPVAGGGESSESEDDGWEIGYLDRTSQKLKRLLPIEEKKEKFKKAMTIGDVSLVQELLDSGISVDSNFQYGWTPLMYAASVANAELVRVLLDRGANASFEKDKQSILITACSAHGSEEQILKCVELLLSRNADPNVACRL

SEQ ID NO: 5358 - protein, 44 aa, Homo sapiens
  Payload ID: 1167;
  Gene Symbol: ASZ1;
  Gene Name: ankyrin repeat, SAM and basic leu zipper domain containing 1;
  ENSP ID: ENSP00000402919
MTIGDVSLVQELLDSGISVDSNFQYGWTPLMYAASVANAELVRV

SEQ ID NO: 5359 - protein, 763 aa, Homo sapiens
  Payload ID: 1168;
  Gene Symbol: ANKFN1;
  Gene Name: ankyrin-repeat and fibronectin type III domain containing 1;
  Uniprot ID:  Q8N957;
  ENSP ID: ENSP00000321627
MEASLTRRLLFKDRHFTCSKIIGRRFACFAQRLSHRRKQSQCDLLNESTGQLPTTCSSAASNSINWNCRVKMTQQMQNLHLCQSKKHSAPSSPNAAKRLYRNLSEKLKGSHSSFDEAYFRTRTDRLSLRKTSVNFQGNEAMFEAVEQQDMDAVQILLYQYTPEELDLNTPNSEGLTPLDIAIMTNNVPIARILLRTGARESPHFVSLESRAMHLNTLVQEAQERVSELSAQVENEGFTLDNTEKEKQLKAWEWRYRLYRRMKTGFEHARAPEMPTNVCLMVTSSTSLTVSFQEPLSVNAAVVTRYKVEWSMSEDFSPLAGEIIMDNLQTLRCTITGLTMGQQYFVQVSAYNMKGWGPAQTTTPACASPSNWKDYDDREPRHKGQSEVLEGLLQQVRALHQHYSCRESTKLQTTGRKQSVSRSLKHLFHSSNKFVKTLKRGLYIAVIFYYKDNILVTNEDQVPIVEIDDSHTSSITQDFLWFTKLSCMWEDIRWLRQSIPISSSSSTVLQTRQKMLAATAQLQNLLGTHNLGRVYYEPIKDRHGNILIVTIREVEMLYSFFNGKWMQISKLQSQRKSLSTPEEPTALDILLITIQDILSYHKRSHQRLFPGLYLGYLKLCSSVDQIKVLVTQKLPNILCHVKIRENNNISREEWEWIQKLSGSESMESVDHTSDCPMQLFFYELQMAVKALLQQINIPLHQARNFRLYTQEVLEMGHNVSFLLLLPASDDVCTAPGQNNPYTPHSGFLNLPLQMFELGIVACFT

SEQ ID NO: 5360 - protein, 1149 aa, Homo sapiens
  Payload ID: 1168;
  Gene Symbol: ANKFN1;
  Gene Name: ankyrin-repeat and fibronectin type III domain containing 1;
  ENSP ID: ENSP00000454224
MEASLTRRLLFKDRHFTCSKIIGRRFACFAQRLSHRRKQSQCDLLNESTGQLPTTCSSAASNSINWNCRVKMTQQMQNLHLCQSKKHSAPSSPNAAKRLYRNLSEKLKGSHSSFDEAYFRTRTDRLSLRKTSVNFQGNEAMFEAVEQQDMDAVQILLYQYTPEELDLNTPNSEGLTPLDIAIMTNNVPIARILLRTGARESPHFVSLESRAMHLNTLVQEAQERVSELSAQVENEGFTLDNTEKEKQLKAWEWRYRLYRRMKTGFEHARAPEMPTNVCLMVTSSTSLTVSFQEPLSVNAAVVTRYKVEWSMSEDFSPLAGEIIMDNLQTLRCTITGLTMGQQYFVQVSAYNMKGWGPAQTTTPACASPSNWKDYDDREPRHKGQSEVLEGLLQQVRALHQHYSCRESTKLQTTGRKQSVSRSLKHLFHSSNKFVKTLKRGLYIAVIFYYKDNILVTNEDQVPIVEIDDSHTSSITQDFLWFTKLSCMWEDIRWLRQSIPISSSSSTVLQTRQKMLAATAQLQNLLGTHNLGRVYYEPIKDRHGNILIVTIREVEMLYSFFNGKWMQISKLQSQRKSLSTPEEPTALDILLITIQDILSYHKRSHQRLFPGLYLGYLKLCSSVDQIKVLVTQKLPNILCHVKIRENNNISREEWEWIQKLSGSESMESVDHTSDCPMQLFFYELQMAVKALLQQINIPLHQARNFRLYTQEVLEMGHNVSFLLLLPASDDVCTAPGQNNPYTPHSGFLNLPLQMFELVHFCSYREKFISLYCRLSAVVELDSLNTQQSLREAISDSEVAAAKQRHQQVLDFIQQIDEVWREMRWIMDALQYARYKQPVSGLPITKLIDPSDEQSLKKINSTSSSHIDCLPSPPPSPEMHRRKTVSDSQPCSDEEACSEVFLPTNSDYDSSDALSPRDLDLVYLSSHDIAQQTLSGLSGSAPDVLQVHDVKTPLGPGQDPQGEGPNPDHSCAEFLHSLTLTGFTPKNHAKTVSGGRPPLGFLGKRKPGKHPHYGGFSRHHRWLRIHSETQSLSLSEGIYTQHLSQACGLAQEPKEAKRAGPALDDPRGLTLAHAASLPEERNSSLQDARPSVRRLYVEPYAAAVVAQDEKPWASLSPPSGGRITLPSPTGPDVSQEGPTASPMSEILSSML

SEQ ID NO: 5361 - protein, 173 aa, Homo sapiens
  Payload ID: 1168;
  Gene Symbol: ANKFN1;
  Gene Name: ankyrin-repeat and fibronectin type III domain containing 1;
  ENSP ID: ENSP00000458227
MPPGIPTKCAKQPHSGTAGLEEGAEAERLLFKDRHFTCSKIIGRRFACFAQRLSHRRKQSQCDLLNESTGQLPTTCSSAASNSINWNCRVKMTQQMQNLHLCQSKKHSAPSSPNAAKRLYRNLSEKLKGSHSSFDEAYFRTRTDRLSLRKTSVNFQGNEAMFEAVEQQDMDAV

SEQ ID NO: 5362 - protein, 346 aa, Homo sapiens
  Payload ID: 1169;
  Gene Symbol: ANXA1;
  Gene Name: annexin A1;
  Uniprot ID:  P04083;
  ENSP ID: ENSP00000257497
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 5363 - protein, 346 aa, Homo sapiens; identical to SEQ ID NO: 5362
  Payload ID: 1169;
  Gene Symbol: ANXA1;
  Gene Name: annexin A1;
  Uniprot ID:  P04083;
  ENSP ID: ENSP00000366109

SEQ ID NO: 5364 - protein, 204 aa, Homo sapiens
  Payload ID: 1169;
  Gene Symbol: ANXA1;
  Gene Name: annexin A1;
  ENSP ID: ENSP00000412489
MNLILRYTFSKMAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFG

SEQ ID NO: 5365 - protein, 115 aa, Homo sapiens
  Payload ID: 1169;
  Gene Symbol: ANXA1;
  Gene Name: annexin A1;
  ENSP ID: ENSP00000414013
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTP

SEQ ID NO: 5366 - protein, 324 aa, Homo sapiens
  Payload ID: 1170;
  Gene Symbol: ANXA10;
  Gene Name: annexin A10;
  Uniprot ID:  Q9UJ72;
  ENSP ID: ENSP00000352248
MFCGDYVQGTIFPAPNFNPIMDAQMLGGALQGFDCDKDMLINILTQRCNAQRMMIAEAYQSMYGRDLIGDMREQLSDHFKDVMAGLMYPPPLYDAHELWHAMKGVGTDENCLIEILASRTNGEIFQMREAYCLQYSNNLQEDIYSETSGHFRDTLMNLVQGTREEGYTDPAMAAQDAMVLWEACQQKTGEHKTMLQMILCNKSYQQLRLVFQEFQNISGQDMVDAINECYDGYFQELLVAIVLCVRDKPAYFAYRLYSAIHDFGFHNKTVIRILIARSEIDLLTIRKRYKERYGKSLFHDIRNFASGHYKKALLAICAGDAEDY

SEQ ID NO: 5367 - protein, 323 aa, Homo sapiens
  Payload ID: 1170;
  Gene Symbol: ANXA10;
  Gene Name: annexin A10;
  ENSP ID: ENSP00000483710
MFCGDYVQGTIFPAPNFNPIMDAQMLGGALQGFDCDKDMLINILTQRCNAQRMMIAEAYQSMYGRDLIGDMRAAFGSLQRCDGWLMYPPPLYDAHELWHAMKGVGTDENCLIEILASRTNGEIFQMREAYCLQYSNNLQEDIYSETSGHFRDTLMNLVQGTREEGYTDPAMAAQDAMVLWEACQQKTGEHKTMLQMILCNKSYQQLRLVFQEFQNISGQDMVDAINECYDGYFQELLVAIVLCVRDKPAYFAYRLYSAIHDFGFHNKTVIRILIARSEIDLLTIRKRYKERYGKSLFHDIRNFASGHYKKALLAICAGDAEDY

SEQ ID NO: 5368 - protein, 472 aa, Homo sapiens
  Payload ID: 1171;
  Gene Symbol: ANXA11;
  Gene Name: annexin A11;
  Uniprot ID:  P50995;
  ENSP ID: ENSP00000265447
MPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 5369 - protein, 505 aa, Homo sapiens
  Payload ID: 1171;
  Gene Symbol: ANXA11;
  Gene Name: annexin A11;
  Uniprot ID:  P50995;
  ENSP ID: ENSP00000361305
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 5370 - protein, 505 aa, Homo sapiens; identical to SEQ ID NO: 5369
  Payload ID: 1171;
  Gene Symbol: ANXA11;
  Gene Name: annexin A11;
  Uniprot ID:  P50995;
  ENSP ID: ENSP00000398610

SEQ ID NO: 5371 - protein, 505 aa, Homo sapiens; identical to SEQ ID NO: 5369
  Payload ID: 1171;
  Gene Symbol: ANXA11;
  Gene Name: annexin A11;
  Uniprot ID:  P50995;
  ENSP ID: ENSP00000404412

SEQ ID NO: 5372 - protein, 148 aa, Homo sapiens
  Payload ID: 1171;
  Gene Symbol: ANXA11;
  Gene Name: annexin A11;
  ENSP ID: ENSP00000405009
  MOD_RES (1)..(1): Any amino acid
XENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISSISCMPASYGHLEEATCLALKLLRVEGND

SEQ ID NO: 5373 - protein, 150 aa, Homo sapiens
  Payload ID: 1171;
  Gene Symbol: ANXA11;
  Gene Name: annexin A11;
  ENSP ID: ENSP00000414642
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPV

SEQ ID NO: 5374 - protein, 357 aa, Homo sapiens
  Payload ID: 1172;
  Gene Symbol: ANXA13;
  Gene Name: annexin A13;
  Uniprot ID:  P27216;
  ENSP ID: ENSP00000262219
MGNRHSQSYTLSEGSQQLPKGDSQPSTVVQPLSHPSRNGEPEAPQPAKASSPQGFDVDRDAKKLNKACKGMGTNEAAIIEILSGRTSDERQQIKQKYKATYGKELEEVLKSELSGNFEKTALALLDRPSEYAARQLQKAMKGLGTDESVLIEVLCTRTNKEIIAIKEAYQRLFDRSLESDVKGDTSGNLKKILVSLLQANRNEGDDVDKDLAGQDAKDLYDAGEGRWGTDELAFNEVLAKRSYKQLRATFQAYQILIGKDIEEAIEEETSGDLQKAYLTLVRCAQDCEDYFAERLYKSMKGAGTDEETLIRIVVTRAEVDLQGIKAKFQEKYQKSLSDMVRSDTSGDFRKLLVALLH

SEQ ID NO: 5375 - protein, 316 aa, Homo sapiens
  Payload ID: 1172;
  Gene Symbol: ANXA13;
  Gene Name: annexin A13;
  Uniprot ID:  P27216;
  ENSP ID: ENSP00000390809
MGNRHAKASSPQGFDVDRDAKKLNKACKGMGTNEAAIIEILSGRTSDERQQIKQKYKATYGKELEEVLKSELSGNFEKTALALLDRPSEYAARQLQKAMKGLGTDESVLIEVLCTRTNKEIIAIKEAYQRLFDRSLESDVKGDTSGNLKKILVSLLQANRNEGDDVDKDLAGQDAKDLYDAGEGRWGTDELAFNEVLAKRSYKQLRATFQAYQILIGKDIEEAIEEETSGDLQKAYLTLVRCAQDCEDYFAERLYKSMKGAGTDEETLIRIVVTRAEVDLQGIKAKFQEKYQKSLSDMVRSDTSGDFRKLLVALLH

SEQ ID NO: 5376 - protein, 113 aa, Homo sapiens
  Payload ID: 1172;
  Gene Symbol: ANXA13;
  Gene Name: annexin A13;
  ENSP ID: ENSP00000429358
MGTNEAAIIEILSGRTSDERQQIKQKYKATYGKELEEVLKSELSGNFEKTALALLDRPSEYAARQLQKAMKGLGTDESVLIEVLCTRTNKEIIAIKEAYQRLFDRSLESDVKG

SEQ ID NO: 5377 - protein, 357 aa, Homo sapiens
  Payload ID: 1173;
  Gene Symbol: ANXA2;
  Gene Name: annexin A2;
  Uniprot ID:  P07355;
  ENSP ID: ENSP00000346032
MGRQLAGCGDAGKKASFKMSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 5378 - protein, 339 aa, Homo sapiens
  Payload ID: 1173;
  Gene Symbol: ANXA2;
  Gene Name: annexin A2;
  Uniprot ID:  P07355;
  ENSP ID: ENSP00000379342
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 5379 - protein, 339 aa, Homo sapiens; identical to SEQ ID NO: 5378
  Payload ID: 1173;
  Gene Symbol: ANXA2;
  Gene Name: annexin A2;
  Uniprot ID:  P07355;
  ENSP ID: ENSP00000387545

SEQ ID NO: 5380 - protein, 339 aa, Homo sapiens; identical to SEQ ID NO: 5378
  Payload ID: 1173;
  Gene Symbol: ANXA2;
  Gene Name: annexin A2;
  Uniprot ID:  P07355;
  ENSP ID: ENSP00000411352

SEQ ID NO: 5381 - protein, 110 aa, Homo sapiens
  Payload ID: 1173;
  Gene Symbol: ANXA2;
  Gene Name: annexin A2;
  ENSP ID: ENSP00000452858
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYD

SEQ ID NO: 5382 - protein, 69 aa, Homo sapiens
  Payload ID: 1173;
  Gene Symbol: ANXA2;
  Gene Name: annexin A2;
  ENSP ID: ENSP00000452876
MSTVHEILCKLSLEGDHSTPPSAYGSVKAYTNFDAERDALNIETAIKTKGARPEPRSYQTLEKESLVPF

SEQ ID NO: 5383 - protein, 176 aa, Homo sapiens
  Payload ID: 1173;
  Gene Symbol: ANXA2;
  Gene Name: annexin A2;
  ENSP ID: ENSP00000452895
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAK

SEQ ID NO: 5384 - protein, 176 aa, Homo sapiens; identical to SEQ ID NO: 5383
  Payload ID: 1173;
  Gene Symbol: ANXA2;
  Gene Name: annexin A2;
  ENSP ID: ENSP00000452921

SEQ ID NO: 5385 - protein, 81 aa, Homo sapiens
  Payload ID: 1173;
  Gene Symbol: ANXA2;
  Gene Name: annexin A2;
  ENSP ID: ENSP00000452958
MSTVHEILCKLSLEGDHSTPPSAYGSVKAYTNFDAERDALNIETAIKTKGVDEVTIVNILTNRSNAQRQDIAFAYQRRTKK

SEQ ID NO: 5386 - protein, 134 aa, Homo sapiens
  Payload ID: 1173;
  Gene Symbol: ANXA2;
  Gene Name: annexin A2;
  ENSP ID: ENSP00000452981
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICS

SEQ ID NO: 5387 - protein, 119 aa, Homo sapiens
  Payload ID: 1173;
  Gene Symbol: ANXA2;
  Gene Name: annexin A2;
  ENSP ID: ENSP00000453000
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMK

SEQ ID NO: 5388 - protein, 142 aa, Homo sapiens
  Payload ID: 1173;
  Gene Symbol: ANXA2;
  Gene Name: annexin A2;
  ENSP ID: ENSP00000453039
MKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNL

SEQ ID NO: 5389 - protein, 45 aa, Homo sapiens
  Payload ID: 1173;
  Gene Symbol: ANXA2;
  Gene Name: annexin A2;
  ENSP ID: ENSP00000453174
MKGLGTDEDSLIEIICSRTNQELQEINRVYKEMYKTDLEKDIISD

SEQ ID NO: 5390 - protein, 132 aa, Homo sapiens
  Payload ID: 1173;
  Gene Symbol: ANXA2;
  Gene Name: annexin A2;
  ENSP ID: ENSP00000453356
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKVNAWAGNRRGLSH

SEQ ID NO: 5391 - protein, 248 aa, Homo sapiens
  Payload ID: 1173;
  Gene Symbol: ANXA2;
  Gene Name: annexin A2;
  ENSP ID: ENSP00000453464
  MOD_RES (1)..(1): Any amino acid
XNQILIWCQQCQENSPISSVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMK

SEQ ID NO: 5392 - protein, 227 aa, Homo sapiens
  Payload ID: 1173;
  Gene Symbol: ANXA2;
  Gene Name: annexin A2;
  ENSP ID: ENSP00000453556
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQK

SEQ ID NO: 5393 - protein, 65 aa, Homo sapiens
  Payload ID: 1173;
  Gene Symbol: ANXA2;
  Gene Name: annexin A2;
  ENSP ID: ENSP00000453566
MSTVHEILCKLSLEGDHSTPPSAYGSVKAYTNFDAERDALNIETAIKTKGVDEVTIVNILTNRSN

SEQ ID NO: 5394 - protein, 176 aa, Homo sapiens; identical to SEQ ID NO: 5383
  Payload ID: 1173;
  Gene Symbol: ANXA2;
  Gene Name: annexin A2;
  ENSP ID: ENSP00000453579

SEQ ID NO: 5395 - protein, 149 aa, Homo sapiens
  Payload ID: 1173;
  Gene Symbol: ANXA2;
  Gene Name: annexin A2;
  ENSP ID: ENSP00000453663
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKE

SEQ ID NO: 5396 - protein, 119 aa, Homo sapiens; identical to SEQ ID NO: 5387
  Payload ID: 1173;
  Gene Symbol: ANXA2;
  Gene Name: annexin A2;
  ENSP ID: ENSP00000453694

SEQ ID NO: 5397 - protein, 133 aa, Homo sapiens
  Payload ID: 1173;
  Gene Symbol: ANXA2;
  Gene Name: annexin A2;
  ENSP ID: ENSP00000453739
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIIC

SEQ ID NO: 5398 - protein, 4 aa, Homo sapiens
  Payload ID: 1173;
  Gene Symbol: ANXA2;
  Gene Name: annexin A2;
  ENSP ID: ENSP00000453742
MSWP

SEQ ID NO: 5399 - protein, 230 aa, Homo sapiens
  Payload ID: 1173;
  Gene Symbol: ANXA2;
  Gene Name: annexin A2;
  ENSP ID: ENSP00000453754
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKGGI

SEQ ID NO: 5400 - protein, 146 aa, Homo sapiens
  Payload ID: 1173;
  Gene Symbol: ANXA2;
  Gene Name: annexin A2;
  ENSP ID: ENSP00000453770
MSWPCDSVINQDHKTKEKNICFQKASFKMSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASM

SEQ ID NO: 5401 - protein, 139 aa, Homo sapiens
  Payload ID: 1173;
  Gene Symbol: ANXA2;
  Gene Name: annexin A2;
  ENSP ID: ENSP00000453841
MKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAF

SEQ ID NO: 5402 - protein, 256 aa, Homo sapiens
  Payload ID: 1173;
  Gene Symbol: ANXA2;
  Gene Name: annexin A2;
  ENSP ID: ENSP00000453859
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAF

SEQ ID NO: 5403 - protein, 59 aa, Homo sapiens
  Payload ID: 1173;
  Gene Symbol: ANXA2;
  Gene Name: annexin A2;
  ENSP ID: ENSP00000453869
MKGLGTDEDSLIEIICSRTNQELQEINRVYKEMYKTDLEKDIISDTSGDFRKLMVALAK

SEQ ID NO: 5404 - protein, 79 aa, Homo sapiens
  Payload ID: 1173;
  Gene Symbol: ANXA2;
  Gene Name: annexin A2;
  ENSP ID: ENSP00000453925
MKGLGTDEDSLIEIICSRTNQELQEINRVYKEMYKTDLEKDIISDTSGDFRKLMVALAKGRRAEDGSVIDYELIDQDAR

SEQ ID NO: 5405 - protein, 47 aa, Homo sapiens
  Payload ID: 1173;
  Gene Symbol: ANXA2;
  Gene Name: annexin A2;
  ENSP ID: ENSP00000453945
MSTVHEILCKLSLEGDHSTPPSAYGSVKAYTNFDAERDALNIETAIK

SEQ ID NO: 5406 - protein, 175 aa, Homo sapiens
  Payload ID: 1173;
  Gene Symbol: ANXA2;
  Gene Name: annexin A2;
  ENSP ID: ENSP00000454096
MSTVHEILCKLSLEGDELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDM

SEQ ID NO: 5407 - protein, 193 aa, Homo sapiens
  Payload ID: 1174;
  Gene Symbol: ANXA2R;
  Gene Name: annexin A2 receptor;
  Uniprot ID:  Q3ZCQ2;
  ENSP ID: ENSP00000315915
MEQHFLGCVKRAWDSAEVAPEPQPPPIVSSEDRGPWPLPLYPVLGEYSLDSCDLGLLSSPCWRLPGVYWQNGLSPGVQSTLEPSTAKPTEFSWPGTQKQQEAPVEEVGQAEEPDRLRLQQLPWSSPLHPWDRQQDTEVCDSGCLLERRHPPALQPWRHLPGFSDCLEWILRVGFAAFSVLWACCSRICGAKQP

SEQ ID NO: 5408 - protein, 193 aa, Homo sapiens; identical to SEQ ID NO: 5407
  Payload ID: 1174;
  Gene Symbol: ANXA2R;
  Gene Name: annexin A2 receptor;
  Uniprot ID:  Q3ZCQ2;
  ENSP ID: ENSP00000479862

SEQ ID NO: 5409 - protein, 323 aa, Homo sapiens
  Payload ID: 1175;
  Gene Symbol: ANXA3;
  Gene Name: annexin A3;
  Uniprot ID:  P12429;
  ENSP ID: ENSP00000264908
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 5410 - protein, 284 aa, Homo sapiens
  Payload ID: 1175;
  Gene Symbol: ANXA3;
  Gene Name: annexin A3;
  ENSP ID: ENSP00000421015
MLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 5411 - protein, 154 aa, Homo sapiens
  Payload ID: 1175;
  Gene Symbol: ANXA3;
  Gene Name: annexin A3;
  ENSP ID: ENSP00000421512
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRK

SEQ ID NO: 5412 - protein, 134 aa, Homo sapiens
  Payload ID: 1175;
  Gene Symbol: ANXA3;
  Gene Name: annexin A3;
  ENSP ID: ENSP00000422281
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYT

SEQ ID NO: 5413 - protein, 284 aa, Homo sapiens; identical to SEQ ID NO: 5410
  Payload ID: 1175;
  Gene Symbol: ANXA3;
  Gene Name: annexin A3;
  ENSP ID: ENSP00000423068

SEQ ID NO: 5414 - protein, 104 aa, Homo sapiens
  Payload ID: 1175;
  Gene Symbol: ANXA3;
  Gene Name: annexin A3;
  ENSP ID: ENSP00000424584
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMK

SEQ ID NO: 5415 - protein, 55 aa, Homo sapiens
  Payload ID: 1175;
  Gene Symbol: ANXA3;
  Gene Name: annexin A3;
  ENSP ID: ENSP00000426591
MASIWGRRDESLKVDEHLAKQDAQILYKAGENRWGTDEDKFTEILCLRSFPQLKL

SEQ ID NO: 5416 - protein, 321 aa, Homo sapiens
  Payload ID: 1176;
  Gene Symbol: ANXA4;
  Gene Name: annexin A4;
  Uniprot ID:  P09525;
  ENSP ID: ENSP00000377833
MAMATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 5417 - protein, 299 aa, Homo sapiens
  Payload ID: 1176;
  Gene Symbol: ANXA4;
  Gene Name: annexin A4;
  ENSP ID: ENSP00000386756
MAMATKGGTVKAASGFNAMEDAQTLRKAMKGLGTDEDAIISVLAYRNTAQRQEIRTAYKSTIGRDLIDDLKSELSGNFEQGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 5418 - protein, 142 aa, Homo sapiens
  Payload ID: 1176;
  Gene Symbol: ANXA4;
  Gene Name: annexin A4;
  ENSP ID: ENSP00000489316
MAMATKGGTVKAASGFNAMEDAQTLRKAMKGLGTDEDAIISVLAYRNTAQRQEIRTAYKSTIGRDLIDDLKSELSGNFEQGAGTDEGCLIEILASRTPEEIRRISQTYQQQYGRSLEDDIRSDTSFMFQRVLVSLSAVSDCF

SEQ ID NO: 5419 - protein, 7 aa, Homo sapiens
  Payload ID: 1176;
  Gene Symbol: ANXA4;
  Gene Name: annexin A4;
  ENSP ID: ENSP00000489464
  MOD_RES (1)..(1): Any amino acid
XTYQQRT

SEQ ID NO: 5420 - protein, 8 aa, Homo sapiens
  Payload ID: 1176;
  Gene Symbol: ANXA4;
  Gene Name: annexin A4;
  ENSP ID: ENSP00000489490
SQTYQQRT

SEQ ID NO: 5421 - protein, 320 aa, Homo sapiens
  Payload ID: 1177;
  Gene Symbol: ANXA5;
  Gene Name: annexin A5;
  Uniprot ID:  P08758;
  ENSP ID: ENSP00000296511
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 5422 - protein, 163 aa, Homo sapiens
  Payload ID: 1177;
  Gene Symbol: ANXA5;
  Gene Name: annexin A5;
  ENSP ID: ENSP00000421421
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQVLRGD

SEQ ID NO: 5423 - protein, 260 aa, Homo sapiens
  Payload ID: 1177;
  Gene Symbol: ANXA5;
  Gene Name: annexin A5;
  ENSP ID: ENSP00000424106
MAQDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 5424 - protein, 220 aa, Homo sapiens
  Payload ID: 1177;
  Gene Symbol: ANXA5;
  Gene Name: annexin A5;
  ENSP ID: ENSP00000424199
MAQVLRGTVTDFPGFDERADAETLRKAMKGLEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 5425 - protein, 35 aa, Homo sapiens
  Payload ID: 1177;
  Gene Symbol: ANXA5;
  Gene Name: annexin A5;
  ENSP ID: ENSP00000427135
MAQVLRGTVTDFPGFDERADAETLRKAMKGLGSSG

SEQ ID NO: 5426 - protein, 673 aa, Homo sapiens
  Payload ID: 1178;
  Gene Symbol: ANXA6;
  Gene Name: annexin A6;
  Uniprot ID:  P08133;
  ENSP ID: ENSP00000346550
MAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 5427 - protein, 330 aa, Homo sapiens
  Payload ID: 1178;
  Gene Symbol: ANXA6;
  Gene Name: annexin A6;
  ENSP ID: ENSP00000366980
MAKPAQGAKYRGSIHDFPGFDPNQDAEALYTAMKGFGSDKEAILDIITSRSNRQRQEVCQSYKSLYGKDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 5428 - protein, 156 aa, Homo sapiens
  Payload ID: 1178;
  Gene Symbol: ANXA6;
  Gene Name: annexin A6;
  ENSP ID: ENSP00000428916
MAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGAGTDEKTLTRIMVSRSEIDLLNIRREFIEKYDKSLHQAIEGDTSGDFLK

SEQ ID NO: 5429 - protein, 460 aa, Homo sapiens
  Payload ID: 1178;
  Gene Symbol: ANXA6;
  Gene Name: annexin A6;
  ENSP ID: ENSP00000430420
MAKPAQGAKYRGSIHDFPGFDPNQDAEALYTAMKGFGSDKEAILDIITSRSNRQRQEVCQSYKSLYGKDLIADLNELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 5430 - protein, 150 aa, Homo sapiens
  Payload ID: 1178;
  Gene Symbol: ANXA6;
  Gene Name: annexin A6;
  ENSP ID: ENSP00000430429
MKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQ

SEQ ID NO: 5431 - protein, 641 aa, Homo sapiens
  Payload ID: 1178;
  Gene Symbol: ANXA6;
  Gene Name: annexin A6;
  Uniprot ID:  P08133;
  ENSP ID: ENSP00000430517
MKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 5432 - protein, 129 aa, Homo sapiens
  Payload ID: 1178;
  Gene Symbol: ANXA6;
  Gene Name: annexin A6;
  ENSP ID: ENSP00000430572
MKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVL

SEQ ID NO: 5433 - protein, 95 aa, Homo sapiens
  Payload ID: 1178;
  Gene Symbol: ANXA6;
  Gene Name: annexin A6;
  ENSP ID: ENSP00000430663
MAKPAQGAKYRGSIHDFPGFDPNQDAEALYTAMKGFGSDKEAILDIITSRSNRQRQEVCQSYKSLYGKDLIADLKYELTGKFERLIVGGLSDVGT

SEQ ID NO: 5434 - protein, 129 aa, Homo sapiens
  Payload ID: 1178;
  Gene Symbol: ANXA6;
  Gene Name: annexin A6;
  ENSP ID: ENSP00000430826
MAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTYTRQGN

SEQ ID NO: 5435 - protein, 110 aa, Homo sapiens
  Payload ID: 1178;
  Gene Symbol: ANXA6;
  Gene Name: annexin A6;
  ENSP ID: ENSP00000431078
MAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGT

SEQ ID NO: 5436 - protein, 91 aa, Homo sapiens
  Payload ID: 1178;
  Gene Symbol: ANXA6;
  Gene Name: annexin A6;
  ENSP ID: ENSP00000431086
  MOD_RES (1)..(1): Any amino acid
XADKLYKSMKGAGTDEKTLTRIMVSRSEIDLLNIRREFIEKYDKSLHQAIEGDTSGDFLKALLALCGGRARVLDQEFGCLGSNLHLPCTCF

SEQ ID NO: 5437 - protein, 488 aa, Homo sapiens
  Payload ID: 1179;
  Gene Symbol: ANXA7;
  Gene Name: annexin A7;
  Uniprot ID:  P20073;
  ENSP ID: ENSP00000362010
MSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQINTDSFSSYPVFSPVSLDYSSEPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 5438 - protein, 466 aa, Homo sapiens
  Payload ID: 1179;
  Gene Symbol: ANXA7;
  Gene Name: annexin A7;
  Uniprot ID:  P20073;
  ENSP ID: ENSP00000362012
MSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 5439 - protein, 144 aa, Homo sapiens
  Payload ID: 1179;
  Gene Symbol: ANXA7;
  Gene Name: annexin A7;
  ENSP ID: ENSP00000378317
MSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPS

SEQ ID NO: 5440 - protein, 21 aa, Homo sapiens
  Payload ID: 1180;
  Gene Symbol: ANXA8;
  Gene Name: annexin A8;
  ENSP ID: ENSP00000462181
MAWWKSWDSGILPLRNALLLG

SEQ ID NO: 5441 - protein, 327 aa, Homo sapiens
  Payload ID: 1180;
  Gene Symbol: ANXA8;
  Gene Name: annexin A8;
  Uniprot ID:  P13928;
  ENSP ID: ENSP00000462880
MAWWKSWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 5442 - protein, 265 aa, Homo sapiens
  Payload ID: 1180;
  Gene Symbol: ANXA8;
  Gene Name: annexin A8;
  Uniprot ID:  P13928;
  ENSP ID: ENSP00000463091
MAWWKSWDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 5443 - protein, 141 aa, Homo sapiens
  Payload ID: 1180;
  Gene Symbol: ANXA8;
  Gene Name: annexin A8;
  Uniprot ID:  P13928;
  ENSP ID: ENSP00000463244
MAWWKSWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEGQQG

SEQ ID NO: 5444 - protein, 276 aa, Homo sapiens
  Payload ID: 1180;
  Gene Symbol: ANXA8;
  Gene Name: annexin A8;
  ENSP ID: ENSP00000464486
MAWWKSWIEQEGVTVKSSSHFNPDPDAETLYKAMKGIGVGSQLLSHQAAAFAFPSSALTSVSPWGQQGHLCCNPAGTNEQAIIDVLTKRSNTQRQQIAKSFKAQFGKDLTETLKSELSGKFERLIVALMYPPYRYEAKELHDAMKGSRDDVSSFVDPGLALQDAQDLYAAGEKIRGTDEMKFITILCTRSATHLLRVKCTQNLHSYFAERLYYAMKGAGTRDGTLIRNIVSRSEIDLNLIKCHFKKMYGKTLSSMIMEDTSGDYKNALLSLVGSDP

SEQ ID NO: 5445 - protein, 365 aa, Homo sapiens
  Payload ID: 1180;
  Gene Symbol: ANXA8;
  Gene Name: annexin A8;
  ENSP ID: ENSP00000478026
MAWWKSWIEQEGVTVKSSSHFNPDPDAETLYKAMKGIGVGSQLLSHQAAAFAFPSSALTSVSPWGQQGHLCCNPAGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 5446 - protein, 365 aa, Homo sapiens
  Payload ID: 1181;
  Gene Symbol: ANXA8L1;
  Gene Name: annexin A8-like 1;
  ENSP ID: ENSP00000462716
MAWWKAWIEQEGVTVKSSSHFNPDPDAETLYKAMKGIGVGSQLLSHQAAAFAFPSSALTSVSPWGQQGHLCCNPAGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPALALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 5447 - protein, 265 aa, Homo sapiens
  Payload ID: 1181;
  Gene Symbol: ANXA8L1;
  Gene Name: annexin A8-like 1;
  ENSP ID: ENSP00000478808
MAWWKAWDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPALALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 5448 - protein, 327 aa, Homo sapiens
  Payload ID: 1181;
  Gene Symbol: ANXA8L1;
  Gene Name: annexin A8-like 1;
  Uniprot ID:  Q5VT79;
  ENSP ID: ENSP00000480221
MAWWKAWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPALALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 5449 - protein, 276 aa, Homo sapiens
  Payload ID: 1181;
  Gene Symbol: ANXA8L1;
  Gene Name: annexin A8-like 1;
  Uniprot ID:  Q5VT79;
  ENSP ID: ENSP00000483608
MAWWKAWIEQEGVTVKSSSHFNPDPDAETLYKAMKGIGVGSQLLSHQAAAFAFPSSALTSVSPWGQQGHLCCNPAGTNEQAIIDVLTKRSNTQRQQIAKSFKAQFGKDLTETLKSELSGKFERLIVALMYPPYRYEAKELHDAMKGSRDDVSSFVDPALALQDAQDLYAAGEKIRGTDEMKFITILCTRSATHLLRVKCTQNLHSYFAERLYYAMKGAGTRDGTLIRNIVSRSEIDLNLIKCHFKKMYGKTLSSMIMEDTSGDYKNALLSLVGSDP

SEQ ID NO: 5450 - protein, 270 aa, Homo sapiens
  Payload ID: 1181;
  Gene Symbol: ANXA8L1;
  Gene Name: annexin A8-like 1;
  ENSP ID: ENSP00000484310
MAWWKAWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGSRDDVSSFVDPALALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 5451 - protein, 345 aa, Homo sapiens
  Payload ID: 1182;
  Gene Symbol: ANXA9;
  Gene Name: annexin A9;
  Uniprot ID:  O76027;
  ENSP ID: ENSP00000357943
MSVTGGKMAPSLTQEILSHLGLASKTAAWGTLGTLRTFLNFSVDKDAQRLLRAITGQGVDRSAIVDVLTNRSREQRQLISRNFQERTQQDLMKSLQAALSGNLERIVMALLQPTAQFDAQELRTALKASDSAVDVAIEILATRTPPQLQECLAVYKHNFQVEAVDDITSETSGILQDLLLALAKGGRDSYSGIIDYNLAEQDVQALQRAEGPSREETWVPVFTQRNPEHLIRVFDQYQRSTGQELEEAVQNRFHGDAQVALLGLASVIKNTPLYFADKLHQALQETEPNYQVLIRILISRCETDLLSIRAEFRKKFGKSLYSSLQDAVKGDCQSALLALCRAEDM

SEQ ID NO: 5452 - protein, 642 aa, Homo sapiens
  Payload ID: 1183;
  Gene Symbol: ANO1;
  Gene Name: anoctamin 1, calcium activated chloride channel;
  Uniprot ID:  Q5XXA6;
  ENSP ID: ENSP00000319477
MLTRPSQVLLNSLSVDPDAECKYGLYFRDGRRKVDYILVYHHKRPSGNRTLVRRVQHSDTPSGARSVKQDHPLPGKGASLDAGSGEPPMDYHEDDKRFRREEYEGNLLEAGLELERDEDTKIHGVGFVKIHAPWNVLCREAEFLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEDHPRAEYEARVLEKSLKKESRNKETDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEEVTEILFISGSPFCLAYDLSTPCTWEKQLQHICSAKSSRFLSFLLETFLFP

SEQ ID NO: 5453 - protein, 986 aa, Homo sapiens
  Payload ID: 1183;
  Gene Symbol: ANO1;
  Gene Name: anoctamin 1, calcium activated chloride channel;
  Uniprot ID:  Q5XXA6;
  ENSP ID: ENSP00000347454
MRVNEKYSTLPAEDRSVHIINICAIEDIGYLPSEGTLLNSLSVDPDAECKYGLYFRDGRRKVDYILVYHHKRPSGNRTLVRRVQHSDTPSGARSVKQDHPLPGKGASLDAGSGEPPMDYHEDDKRFRREEYEGNLLEAGLELERDEDTKIHGVGFVKIHAPWNVLCREAEFLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEEAVKDHPRAEYEARVLEKSLKKESRNKEKRRHIPEESTNKWKQRVKTAMAGVKLTDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEECAPGGCLMELCIQLSIIMLGKQLIQNNLFEIGIPKMKKLIRYLKLKQQSPPDHEECVKRKQRYEVDYNLEPFAGLTPEYMEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 5454 - protein, 695 aa, Homo sapiens
  Payload ID: 1183;
  Gene Symbol: ANO1;
  Gene Name: anoctamin 1, calcium activated chloride channel;
  ENSP ID: ENSP00000432843
MGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEEAVKDHPRAEYEARVLEKSLKKESRNKETDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEECAPGGCLMELCIQLSIIMLGKQLIQNNLFEIGIPKMKKLIRYLKLKQQSPPDHEECVKRKQRYEVDYNLEPFAGLTPEYMEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 5455 - protein, 269 aa, Homo sapiens
  Payload ID: 1183;
  Gene Symbol: ANO1;
  Gene Name: anoctamin 1, calcium activated chloride channel;
  ENSP ID: ENSP00000433445
  MOD_RES (1)..(1): Any amino acid
XHAPWNVLCREAEFLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGQGEGRKKDSALLSKRRKCGKYGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLF

SEQ ID NO: 5456 - protein, 840 aa, Homo sapiens
  Payload ID: 1183;
  Gene Symbol: ANO1;
  Gene Name: anoctamin 1, calcium activated chloride channel;
  Uniprot ID:  Q5XXA6;
  ENSP ID: ENSP00000435797
MDYHEDDKRFRREEYEGNLLEAGLELERDEDTKIHGVGFVKIHAPWNVLCREAEFLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEDHPRAEYEARVLEKSLKKESRNKETDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEECAPGGCLMELCIQLSIIMLGKQLIQNNLFEIGIPKMKKLIRYLKLKQQSPPDHEECVKRKQRYEVDYNLEPFAGLTPEYMEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 5457 - protein, 151 aa, Homo sapiens
  Payload ID: 1183;
  Gene Symbol: ANO1;
  Gene Name: anoctamin 1, calcium activated chloride channel;
  ENSP ID: ENSP00000435868
MEHWKRKQMRLNYRWDLTGFEEEEEAVKDHPRAEYEARVLEKSLKKESRNKETDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEK

SEQ ID NO: 5458 - protein, 251 aa, Homo sapiens
  Payload ID: 1183;
  Gene Symbol: ANO1;
  Gene Name: anoctamin 1, calcium activated chloride channel;
  ENSP ID: ENSP00000436392
MRVNEKYSTLPAEDRSVHIINICAIEDIGYLPSEGTLLNSLSVDPDAECKYGLYFRDGRRKVDYILVYHHKRPSGNRTLVRRVQHSDTPSGARSVKQDHPLPGKGASLDAGSGEPPMDYHEDDKRFRREEYEGNLLEAGLELERDEDMYHINETRGLLKKINSVLQKITDPIQPKVAEHRPQTMKRLSYPFSREKQHLFDLSDKDSFFDSKTRSTIVYEILKRTTCTKAKYSMGITSLLANGVYAAAYPLH

SEQ ID NO: 5459 - protein, 660 aa, Homo sapiens
  Payload ID: 1184;
  Gene Symbol: ANO10;
  Gene Name: anoctamin 10;
  Uniprot ID:  Q9NW15;
  ENSP ID: ENSP00000292246
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGYPQAKLYPGKSLLRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 5460 - protein, 470 aa, Homo sapiens
  Payload ID: 1184;
  Gene Symbol: ANO10;
  Gene Name: anoctamin 10;
  Uniprot ID:  Q9NW15;
  ENSP ID: ENSP00000327767
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGYPQAKLYPGKSLLRRLLTSGIVIQVFPLHDSEALKKLEDTWYTRFALKYQPIENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 5461 - protein, 594 aa, Homo sapiens
  Payload ID: 1184;
  Gene Symbol: ANO10;
  Gene Name: anoctamin 10;
  Uniprot ID:  Q9NW15;
  ENSP ID: ENSP00000379398
MKVTLSALDTSESSFTPLVVIELAQDVKEETKEWLKNRIIAKKKDGDNNDDFLTMAECQFIIKHELENLRAKDEKMIPGYPQAKLYPGKSLLRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 5462 - protein, 549 aa, Homo sapiens
  Payload ID: 1184;
  Gene Symbol: ANO10;
  Gene Name: anoctamin 10;
  Uniprot ID:  Q9NW15;
  ENSP ID: ENSP00000394119
MKVTLSALDTSESSFTPLVVIELAQDVKEETKEWLKNRIIAKKKDGVRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 5463 - protein, 627 aa, Homo sapiens
  Payload ID: 1184;
  Gene Symbol: ANO10;
  Gene Name: anoctamin 10;
  Uniprot ID:  Q9NW15;
  ENSP ID: ENSP00000396990
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGYPQAKLYPGKSLLRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEAASCKLVSLPRYSWSTNSVPGTVIGPGV

SEQ ID NO: 5464 - protein, 134 aa, Homo sapiens
  Payload ID: 1184;
  Gene Symbol: ANO10;
  Gene Name: anoctamin 10;
  ENSP ID: ENSP00000397360
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELEN

SEQ ID NO: 5465 - protein, 140 aa, Homo sapiens
  Payload ID: 1184;
  Gene Symbol: ANO10;
  Gene Name: anoctamin 10;
  ENSP ID: ENSP00000399103
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDE

SEQ ID NO: 5466 - protein, 146 aa, Homo sapiens
  Payload ID: 1184;
  Gene Symbol: ANO10;
  Gene Name: anoctamin 10;
  ENSP ID: ENSP00000402010
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGY

SEQ ID NO: 5467 - protein, 141 aa, Homo sapiens
  Payload ID: 1184;
  Gene Symbol: ANO10;
  Gene Name: anoctamin 10;
  ENSP ID: ENSP00000402845
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEK

SEQ ID NO: 5468 - protein, 38 aa, Homo sapiens
  Payload ID: 1184;
  Gene Symbol: ANO10;
  Gene Name: anoctamin 10;
  ENSP ID: ENSP00000404988
MKVTLSALDTSESSFTPLVVIELAQDVKEETKEWLKNR

SEQ ID NO: 5469 - protein, 192 aa, Homo sapiens
  Payload ID: 1184;
  Gene Symbol: ANO10;
  Gene Name: anoctamin 10;
  ENSP ID: ENSP00000406432
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGYPQAKLYPGKSLFQLPQLLCLTLLYCLCLERYEAFAPELGHSPNYLP

SEQ ID NO: 5470 - protein, 112 aa, Homo sapiens
  Payload ID: 1184;
  Gene Symbol: ANO10;
  Gene Name: anoctamin 10;
  ENSP ID: ENSP00000406712
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFD

SEQ ID NO: 5471 - protein, 188 aa, Homo sapiens
  Payload ID: 1184;
  Gene Symbol: ANO10;
  Gene Name: anoctamin 10;
  ENSP ID: ENSP00000412997
  MOD_RES (1)..(1): Any amino acid
XCVYPLAAAFAVLNNFTEVNSDALKMCRVFKRPFSEPSANIGVWQIIFCLDTGVKRGLNCKVMRNLLGEMEMSCVLFVVVVVSQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 5472 - protein, 162 aa, Homo sapiens
  Payload ID: 1184;
  Gene Symbol: ANO10;
  Gene Name: anoctamin 10;
  ENSP ID: ENSP00000416266
MKVTLSALDTSESSFTPLVVIELAQDVKEETKEWLKNRIIAKKKDGVRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWG

SEQ ID NO: 5473 - protein, 999 aa, Homo sapiens
  Payload ID: 1185;
  Gene Symbol: ANO2;
  Gene Name: anoctamin 2, calcium activated chloride channel;
  Uniprot ID:  Q9NQ90;
  ENSP ID: ENSP00000314048
MPEDIPLLPGSPRRLSPQAGSRGGQGPKHGQQCLKMPGPRAPGLQGGSNRDPGQPCGGESTRSSSVINNYLDANEPVSLEARLSRMHFHDSQRKVDYVLAYHYRKRGVHLAQGFPGHSLAIVSNGETGKEPHAGGPGDIELGPLDALEEERKEQREEFEHNLMEAGLELEKDLENKSQGSIFVRIHAPWQVLAREAEFLKIKVPTKKEMYEIKAGGSIAKKFSAALQKLSSHLQPRVPEHSNNKMKNLSYPFSREKMYLYNIQEKDTFFDNATRSRIVHEILKRTACSRANNTMGINSLIANNIYEAAYPLHDGEYDSPEDDMNDRKLLYQEWARYGVFYKFQPIDLIRKYFGEKIGLYFAWLGLYTSFLIPSSVIGVIVFLYGCATIEEDIPSREMCDQQNAFTMCPLCDKSCDYWNLSSACGTAQASHLFDNPATVFFSIFMALWATMFLENWKRLQMRLGYFWDLTGIEEEEERAQEHSRPEYETKVREKMLKESNQSAVQKLETNTTECGDEDDEDKLTWKDRFPGYLMNFASILFMIALTFSIVFGVIVYRITTAAALSLNKATRSNVRVTVTATAVIINLVVILILDEIYGAVAKWLTKIEVPKTEQTFEERLILKAFLLKFVNAYSPIFYVAFFKGRFVGRPGSYVYVFDGYRMEECAPGGCLMELCIQLSIIMLGKQLIQNNIFEIGVPKLKKLFRKLKDETEAGETDSAHSKHPEQWDLDYSLEPYTGLTPEYMEMIIQFGFVTLFVASFPLAPVFALLNNVIEVRLDAKKFVTELRRPDAVRTKDIGIWFDILSGIGKFSVISNAFVIAITSDFIPRLVYQYSYSHNGTLHGFVNHTLSFFNVSQLKEGTQPENSQFDQEVQFCRFKDYREPPWAPNPYEFSKQYWFILSARLAFVIIFQNLVMFLSVLVDWMIPDIPTDISDQIKKEKSLLVDFFLKEEHEKLKLMDEPALRSPGGGDRSRSRAASSAPSGQSQLGSMMSSGSQHTNV

SEQ ID NO: 5474 - protein, 999 aa, Homo sapiens; identical to SEQ ID NO: 5473
  Payload ID: 1185;
  Gene Symbol: ANO2;
  Gene Name: anoctamin 2, calcium activated chloride channel;
  Uniprot ID:  Q9NQ90;
  ENSP ID: ENSP00000348453

SEQ ID NO: 5475 - protein, 1003 aa, Homo sapiens
  Payload ID: 1185;
  Gene Symbol: ANO2;
  Gene Name: anoctamin 2, calcium activated chloride channel;
  ENSP ID: ENSP00000440981
MATPGPRDIPLLPGSPRRLSPQAGSRGGQGPKHGQQCLKMPGPRAPGLQGGSNRDPGQPCGGESTRSSSVINNYLDANEPVSLEARLSRMHFHDSQRKVDYVLAYHYRKRGVHLAQGFPGHSLAIVSNGETGKEPHAGGPGDIELGPLDALEEERKEQREEFEHNLMEAGLELEKDLENKSQGSIFVRIHAPWQVLAREAEFLKIKVPTKKEMYEIKAGGSIAKKFSAALQKLSSHLQPRVPEHSNNKMKNLSYPFSREKMYLYNIQEKDTFFDNATRSRIVHEILKRTACSRANNTMGINSLIANNIYEAAYPLHDGEYDSPEDDMNDRKLLYQEWARYGVFYKFQPIDLIRKYFGEKIGLYFAWLGLYTSFLIPSSVIGVIVFLYGCATIEEDIPSREMCDQQNAFTMCPLCDKSCDYWNLSSACGTAQASHLFDNPATVFFSIFMALWATMFLENWKRLQMRLGYFWDLTGIEEEEVSSQEHSRPEYETKVREKMLKESNQSAVQKLETNTTECGDEDDEDKLTWKDRFPGYLMNFASILFMIALTFSIVFGVIVYRITTAAALSLNKATRSNVRVTVTATAVIINLVVILILDEIYGAVAKWLTKIEVPKTEQTFEERLILKAFLLKFVNAYSPIFYVAFFKGRFVGRPGSYVYVFDGYRMEECAPGGCLMELCIQLSIIMLGKQLIQNNIFEIGVPKLKKLFRKLKDETEAGETDSAHSKHPEQWDLDYSLEPYTGLTPEYMEMIIQFGFVTLFVASFPLAPVFALLNNVIEVRLDAKKFVTELRRPDAVRTKDIGIWFDILSGIGKFSVISNAFVIAITSDFIPRLVYQYSYSHNGTLHGFVNHTLSFFNVSQLKEGTQPENSQFDQEVQFCRFKDYREPPWAPNPYEFSKQYWFILSARLAFVIIFQNLVMFLSVLVDWMIPDIPTDISDQIKKEKSLLVDFFLKEEHEKLKLMDEPALRSPGGGDRSRSRAASSAPSGQSQLGSMMSSGSQHTNV

SEQ ID NO: 5476 - protein, 203 aa, Homo sapiens
  Payload ID: 1185;
  Gene Symbol: ANO2;
  Gene Name: anoctamin 2, calcium activated chloride channel;
  ENSP ID: ENSP00000443813
MGWKAESLESATMFLENWKRLQMRLGYFWDLTGIEEEEEHSRPEYETKVREKMLKESNQSAVQKLETNTTECGDEDDEDKLTWKDRFPGYLMNFASILFMIALTFSIVFGVIVYRITTAAALSLNKATRSNVRVTVTATAVIINLVVILILDEIYGAVAKWLTKIEVPKTEQTFEERLILKAFLLKFVNAYSPIFYVAFFKGR

SEQ ID NO: 5477 - protein, 86 aa, Homo sapiens
  Payload ID: 1185;
  Gene Symbol: ANO2;
  Gene Name: anoctamin 2, calcium activated chloride channel;
  ENSP ID: ENSP00000481449
MFLSVLVDWMIPDIPTDISDQIKKEKSLLVDFFLKEEHEKLKLMDEPALRSPGGGDRSRSRAASSAPSGQSQLGSMMSSGSQHTNV

SEQ ID NO: 5478 - protein, 981 aa, Homo sapiens
  Payload ID: 1186;
  Gene Symbol: ANO3;
  Gene Name: anoctamin 3;
  Uniprot ID:  Q9BYT9;
  ENSP ID: ENSP00000256737
MVHHSGSIQSFKQQKGMNISKSEITKETSLKPSRRSLPCLAQSYAYSKSLSQSTSLFQSTESESQAPTSITLISTDKAEQVNTEENKNDSVLRCSFADLSDFCLALGKDKDYTDESEHATYDRSRLINDFVIKDKSEFKTKLSKNDMNYIASSGPLFKDGKKRIDYILVYRKTNIQYDKRNTFEKNLRAEGLMLEKEPAIASPDIMFIKIHIPWDTLCKYAERLNIRMPFRKKCYYTDGRSKSMGRMQTYFRRIKNWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWATVFLEFWKRRRSILTYTWDLIEWEEEEETLRPQFEAKYYKMEIVNPITGKPEPHQPSSDKVTRLLVSVSGIFFMISLVITAVFGVVVYRLVVMEQFASFKWNFIKQYWQFATSAAAVCINFIIIMLLNLAYEKIAYLLTNLEYPRTESEWENSFALKMFLFQFVNLNSSIFYIAFFLGRFVGHPGKYNKLFDRWRLEECHPSGCLIDLCLQMGVIMFLKQIWNNFMELGYPLIQNWWSRHKIKRGIHDASIPQWENDWNLQPMNLHGLMDEYLEMVLQFGFTTIFVAAFPLAPLLALLNNIIEIRLDAYKFVTQWRRPLPARATDIGIWLGILEGIGILAVITNAFVIAITSDYIPRFVYEYKYGPCANHVEPSENCLKGYVNNSLSFFDLSELGMGKSGYCRYRDYRGPPWSSKPYEFTLQYWHILAARLAFIIVFEHLVFGIKSFIAYLIPDVPKGLHDRIRREKYLVQEMMYEAELEHLQQQRRKSGQPVHHEWP

SEQ ID NO: 5479 - protein, 835 aa, Homo sapiens
  Payload ID: 1186;
  Gene Symbol: ANO3;
  Gene Name: anoctamin 3;
  Uniprot ID:  Q9BYT9;
  ENSP ID: ENSP00000432394
MNYIASSGPLFKDGKKRIDYILVYRKTNIQYDKRNTFEKNLRAEGLMLEKEPAIASPDIMFIKIHIPWDTLCKYAERLNIRMPFRKKCYYTDGRSKSMGRMQTYFRRIKNWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWATVFLEFWKRRRSILTYTWDLIEWEEEEETLRPQFEAKYYKMEIVNPITGKPEPHQPSSDKVTRLLVSVSGIFFMISLVITAVFGVVVYRLVVMEQFASFKWNFIKQYWQFATSAAAVCINFIIIMLLNLAYEKIAYLLTNLEYPRTESEWENSFALKMFLFQFVNLNSSIFYIAFFLGRFVGHPGKYNKLFDRWRLEECHPSGCLIDLCLQMGVIMFLKQIWNNFMELGYPLIQNWWSRHKIKRGIHDASIPQWENDWNLQPMNLHGLMDEYLEMVLQFGFTTIFVAAFPLAPLLALLNNIIEIRLDAYKFVTQWRRPLPARATDIGIWLGILEGIGILAVITNAFVIAITSDYIPRFVYEYKYGPCANHVEPSENCLKGYVNNSLSFFDLSELGMGKSGYCRYRDYRGPPWSSKPYEFTLQYWHILAARLAFIIVFEHLVFGIKSFIAYLIPDVPKGLHDRIRREKYLVQEMMYEAELEHLQQQRRKSGQPVHHEWP

SEQ ID NO: 5480 - protein, 965 aa, Homo sapiens
  Payload ID: 1186;
  Gene Symbol: ANO3;
  Gene Name: anoctamin 3;
  ENSP ID: ENSP00000432576
MNISKSEITKETSLKPSRRSLPCLAQSYAYSKSLSQSTSLFQSTESESQAPTSITLISTDKAEQVNTEENKNDSVLRCSFADLSDFCLALGKDKDYTDESEHATYDRSRLINDFVIKDKSEFKTKLSKNDMNYIASSGPLFKDGKKRIDYILVYRKTNIQYDKRNTFEKNLRAEGLMLEKEPAIASPDIMFIKIHIPWDTLCKYAERLNIRMPFRKKCYYTDGRSKSMGRMQTYFRRIKNWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWATVFLEFWKRRRSILTYTWDLIEWEEEEETLRPQFEAKYYKMEIVNPITGKPEPHQPSSDKVTRLLVSVSGIFFMISLVITAVFGVVVYRLVVMEQFASFKWNFIKQYWQFATSAAAVCINFIIIMLLNLAYEKIAYLLTNLEYPRTESEWENSFALKMFLFQFVNLNSSIFYIAFFLGRFVGHPGKYNKLFDRWRLEECHPSGCLIDLCLQMGVIMFLKQIWNNFMELGYPLIQNWWSRHKIKRGIHDASIPQWENDWNLQPMNLHGLMDEYLEMVLQFGFTTIFVAAFPLAPLLALLNNIIEIRLDAYKFVTQWRRPLPARATDIGIWLGILEGIGILAVITNAFVIAITSDYIPRFVYEYKYGPCANHVEPSENCLKGYVNNSLSFFDLSELGMGKSGYCRYRDYRGPPWSSKPYEFTLQYWHILAARLAFIIVFEHLVFGIKSFIAYLIPDVPKGLHDRIRREKYLVQEMMYEAELEHLQQQRRKSGQPVHHEWP

SEQ ID NO: 5481 - protein, 206 aa, Homo sapiens
  Payload ID: 1186;
  Gene Symbol: ANO3;
  Gene Name: anoctamin 3;
  ENSP ID: ENSP00000435275
MVHHSGSIQSFKQQKGMNISKSEITKETSLKPSRRSLPCLAQSYAYSKSLSQSTSLFQSTESESQAPTSITLISTDKAEQVNTEENKNDSVLRCSFADLSDFCLALGKDKDYTDESEHATYDRSRLINDFVIKDKSEFKTKLSKNDMNYIASSGPLFKDGKKRIDYILVYRKTNIQYDKRNTFEKNLRAEGLMLEKEVGALLLLVM

SEQ ID NO: 5482 - protein, 955 aa, Homo sapiens
  Payload ID: 1187;
  Gene Symbol: ANO4;
  Gene Name: anoctamin 4;
  Uniprot ID:  Q32M45;
  ENSP ID: ENSP00000376703
MEASSSGITNGKTKVFHPEGGVDLQGYQLDMQILPDGPKSDVDFSEILNAIQEMAKDVNILFDELEAVSSPCKDDDSLLHPGNLTSTSDDASRLEAGGETVPERNKSNGLYFRDGKCRIDYILVYRKSNPQTEKREVFERNIRAEGLQMEKESSLINSDIIFVKLHAPWEVLGRYAEQMNVRMPFRRKIYYLPRRYKFMSRIDKQISRFRRWLPKKPMRLDKETLPDLEENDCYTAPFSQQRIHHFIIHNKETFFNNATRSRIVHHILQRIKYEEGKNKIGLNRLLTNGSYEAAFPLHEGSYRSKNSIRTHGAENHRHLLYECWASWGVWYKYQPLDLVRRYFGEKIGLYFAWLGWYTGMLFPAAFIGLFVFLYGVTTLDHSQVSKEVCQATDIIMCPVCDKYCPFMRLSDSCVYAKVTHLFDNGATVFFAVFMAVWATVFLEFWKRRRAVIAYDWDLIDWEEEEEEIRPQFEAKYSKKERMNPISGKPEPYQAFTDKCSRLIVSASGIFFMICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 5483 - protein, 920 aa, Homo sapiens
  Payload ID: 1187;
  Gene Symbol: ANO4;
  Gene Name: anoctamin 4;
  Uniprot ID:  Q32M45;
  ENSP ID: ENSP00000376705
MEASSSGITNGKTKVFHPVAKDVNILFDELEAVSSPCKDDDSLLHPGNLTSTSDDASRLEAGGETVPERNKSNGLYFRDGKCRIDYILVYRKSNPQTEKREVFERNIRAEGLQMEKESSLINSDIIFVKLHAPWEVLGRYAEQMNVRMPFRRKIYYLPRRYKFMSRIDKQISRFRRWLPKKPMRLDKETLPDLEENDCYTAPFSQQRIHHFIIHNKETFFNNATRSRIVHHILQRIKYEEGKNKIGLNRLLTNGSYEAAFPLHEGSYRSKNSIRTHGAENHRHLLYECWASWGVWYKYQPLDLVRRYFGEKIGLYFAWLGWYTGMLFPAAFIGLFVFLYGVTTLDHSQVSKEVCQATDIIMCPVCDKYCPFMRLSDSCVYAKVTHLFDNGATVFFAVFMAVWATVFLEFWKRRRAVIAYDWDLIDWEEEEEEIRPQFEAKYSKKERMNPISGKPEPYQAFTDKCSRLIVSASGIFFMICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 5484 - protein, 11 aa, Homo sapiens
  Payload ID: 1187;
  Gene Symbol: ANO4;
  Gene Name: anoctamin 4;
  ENSP ID: ENSP00000447867
MEASSSGITNG

SEQ ID NO: 5485 - protein, 190 aa, Homo sapiens
  Payload ID: 1187;
  Gene Symbol: ANO4;
  Gene Name: anoctamin 4;
  ENSP ID: ENSP00000449116
MEASSSGITNGKTKVFHPEGGVDLQGYQLDMQILPDGPKSDVDFSEILNAIQEMAKDVNILFDELEAVSSPCKDDDSLLHPGNLTSTSDDASRLEAGGETVPERNKSNGLYFRDGKCRIDYILVYRKSNPQTEKREVFERNIRAEGLQMEKESSLINSDIIFVKLHAPWEVLGRYAEQMNVRMPFSSNCN

SEQ ID NO: 5486 - protein, 475 aa, Homo sapiens
  Payload ID: 1187;
  Gene Symbol: ANO4;
  Gene Name: anoctamin 4;
  Uniprot ID:  Q32M45;
  ENSP ID: ENSP00000450192
MAVWATVFLEFWKRRRAVIAYDWDLIDWEEEEICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 5487 - protein, 176 aa, Homo sapiens
  Payload ID: 1187;
  Gene Symbol: ANO4;
  Gene Name: anoctamin 4;
  Uniprot ID:  Q32M45;
  ENSP ID: ENSP00000469449
  MOD_RES (1)..(1): Any amino acid
XSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 5488 - protein, 176 aa, Homo sapiens; identical to SEQ ID NO: 5487
  Payload ID: 1187;
  Gene Symbol: ANO4;
  Gene Name: anoctamin 4;
  Uniprot ID:  Q32M45;
  ENSP ID: ENSP00000470039
  MOD_RES (1)..(1): Any amino acid

SEQ ID NO: 5489 - protein, 176 aa, Homo sapiens; identical to SEQ ID NO: 5487
  Payload ID: 1187;
  Gene Symbol: ANO4;
  Gene Name: anoctamin 4;
  Uniprot ID:  Q32M45;
  ENSP ID: ENSP00000471431
  MOD_RES (1)..(1): Any amino acid

SEQ ID NO: 5490 - protein, 913 aa, Homo sapiens
  Payload ID: 1188;
  Gene Symbol: ANO5;
  Gene Name: anoctamin 5;
  Uniprot ID:  Q75V66;
  ENSP ID: ENSP00000315371
MGDPDLLEVLAEEGEKVNKHIDYSFQMSEQSLSSRETSFLINEETMPAKRFNLFLRRRLMFQKNQQSKDSIFFRDGIRQIDFVLSYVDDVKKDAELKAERRKEFETNLRKTGLELEIEDKRDSEDGRTYFVKIHAPWEVLVTYAEVLGIKMPIKESDIPRPKHTPISYVLGPVRLPLSVKYPHPEYFTAQFSRHRQELFLIEDQATFFPSSSRNRIVYYILSRCPFGIEDGKKRFGIERLLNSNTYSSAYPLHDGQYWKPSEPPNPTNERYTLHQNWARFSYFYKEQPLDLIKNYYGEKIGIYFVFLGFYTEMLFFAAVVGLACFIYGLLSMEHNTSSTEICDPEIGGQMIMCPLCDQVCDYWRLNSTCLASKFSHLFDNESTVFFAIFMGIWVTLFLEFWKQRQARLEYEWDLVDFEEEQQQLQLRPEFEAMCKHRKLNAVTKEMEPYMPLYTRIPWYFLSGATVTLWMSLVVTSMVAVIVYRLSVFATFASFMESDASLKQVKSFLTPQITTSLTGSCLNFIVILILNFFYEKISAWITKMEIPRTYQEYESSLTLKMFLFQFVNFYSSCFYVAFFKGKFVGYPGKYTYLFNEWRSEECDPGGCLIELTTQLTIIMTGKQIFGNIKEAIYPLALNWWRRRKARTNSEKLYSRWEQDHDLESFGPLGLFYEYLETVTQFGFVTLFVASFPLAPLLALINNIVEIRVDAWKLTTQYRRTVASKAHSIGVWQDILYGMAVLSVATNAFIVAFTSDIIPRLVYYYAYSTNATQPMTGYVNNSLSVFLIADFPNHTAPSEKRDFITCRYRDYRYPPDDENKYFHNMQFWHVLAAKMTFIIVMEHVVFLVKFLLAWMIPDVPKDVVERIKREKLMTIKILHDFELNKLKENLGINSNEFAKHVMIEENKAQLAKSTL

SEQ ID NO: 5491 - protein, 910 aa, Homo sapiens
  Payload ID: 1189;
  Gene Symbol: ANO6;
  Gene Name: anoctamin 6;
  Uniprot ID:  Q4KMQ2;
  ENSP ID: ENSP00000320087
MKKMSRNVLLQMEEEEDDDDGDIVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEHVIYSVKFFISYAIPDVSKRTKSKIQREKYLTQKLLHENHLKDMTKNMGVIAERMIEAVDNNLRPKSE

SEQ ID NO: 5492 - protein, 929 aa, Homo sapiens
  Payload ID: 1189;
  Gene Symbol: ANO6;
  Gene Name: anoctamin 6;
  Uniprot ID:  Q4KMQ2;
  ENSP ID: ENSP00000391417
MKKMSRNVLLQMEEEEDDDDGDIVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEYLALLPRLGHSGMILAHCNLRLPVDCCMCYRFVDEIRLLEQLTSDFIDSLYYIFSISIISIFFSVTFFFLLLSLGPTPCFSVSNFLS

SEQ ID NO: 5493 - protein, 931 aa, Homo sapiens
  Payload ID: 1189;
  Gene Symbol: ANO6;
  Gene Name: anoctamin 6;
  Uniprot ID:  Q4KMQ2;
  ENSP ID: ENSP00000409126
MKKMSRNVLLQMEEEEDDDDGDIGDVPASRRPFLTPHTHLPSSLVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEHVIYSVKFFISYAIPDVSKRTKSKIQREKYLTQKLLHENHLKDMTKNMGVIAERMIEAVDNNLRPKSE

SEQ ID NO: 5494 - protein, 892 aa, Homo sapiens
  Payload ID: 1189;
  Gene Symbol: ANO6;
  Gene Name: anoctamin 6;
  Uniprot ID:  Q4KMQ2;
  ENSP ID: ENSP00000413137
MFCAAVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEHVIYSVKFFISYAIPDVSKRTKSKIQREKYLTQKLLHENHLKDMTKNMGVIAERMIEAVDNNLRPKSE

SEQ ID NO: 5495 - protein, 45 aa, Homo sapiens
  Payload ID: 1189;
  Gene Symbol: ANO6;
  Gene Name: anoctamin 6;
  ENSP ID: ENSP00000449423
MKKMSRNVLLQMEEEEDDDDGDIGLKCSSGVAQSWLTVALTPRLN

SEQ ID NO: 5496 - protein, 933 aa, Homo sapiens
  Payload ID: 1190;
  Gene Symbol: ANO7;
  Gene Name: anoctamin 7;
  Uniprot ID:  Q6IWH7;
  ENSP ID: ENSP00000274979
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIADFVLVWEEDLKLDRQQDSAARDRTDMHRTWRETFLDNLRAAGLCVDQQDVQDGNTTVHYALLSASWAVLCYYAEDLRLKLPLQELPNQASNWSAGLLAWLGIPNVLLEVVPDVPPEYYSCRFRVNKLPRFLGSDNQDTFFTSTKRHQILFEILAKTPYGHEKKNLLGIHQLLAEGVLSAAFPLHDGPFKTPPEGPQAPRLNQRQVLFQHWARWGKWNKYQPLDHVRRYFGEKVALYFAWLGFYTGWLLPAAVVGTLVFLVGCFLVFSDIPTQELCGSKDSFEMCPLCLDCPFWLLSSACALAQAGRLFDHGGTVFFSLFMALWAVLLLEYWKRKSATLAYRWDCSDYEDTEERPRPQFAASAPMTAPNPITGEDEPYFPERSRARRMLAGSVVIVVMVAVVVMCLVSIILYRAIMAIVVSRSGNTLLAAWASRIASLTGSVVNLVFILILSKIYVSLAHVLTRWEMHRTQTKFEDAFTLKVFIFQFVNFYSSPVYIAFFKGRFVGYPGNYHTLFGVRNEECAAGGCLIELAQELLVIMVGKQVINNMQEVLIPKLKGWWQKFRLRSKKRKAGASAGASQGPWEDDYELVPCEGLFDEYLEMVLQFGFVTIFVAACPLAPLFALLNNWVEIRLDARKFVCEYRRPVAERAQDIGIWFHILAGLTHLAVISNAFLLAFSSDFLPRAYYRWTRAHDLRGFLNFTLARAPSSFAAAHNRTCRYRAFRDDDGHYSQTYWNLLAIRLAFVIVFEHVVFSVGRLLDLLVPDIPESVEIKVKREYYLAKQALAENEVLFGTNGTKDEQPEGSELSSHWTPFTVPKASQLQQ

SEQ ID NO: 5497 - protein, 179 aa, Homo sapiens
  Payload ID: 1190;
  Gene Symbol: ANO7;
  Gene Name: anoctamin 7;
  Uniprot ID:  Q6IWH7;
  ENSP ID: ENSP00000383985
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIDFVLVWEEDLKLDRQQDSAARDRTDMHRTWRETFLDNLRAAGLCVDQVRGGCHGQGPRPCIHSVTHDLAA

SEQ ID NO: 5498 - protein, 883 aa, Homo sapiens
  Payload ID: 1190;
  Gene Symbol: ANO7;
  Gene Name: anoctamin 7;
  Uniprot ID:  Q6IWH7;
  ENSP ID: ENSP00000385418
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIDFVLVWEEDLKLDRQQDSAARDRTDMHRTWRETFLDNLRAAGLCVDQQDVQDGNTTVHYALLSASWAVLCYYAEDLRLKLPLQELPNQASNWSAGLLAWLGIPNVLLEVVPDVPPEYYSCRFRVNKLPRFLGSDNQDTFFTSTKRHQILFEILAKTPYGHEKKNLLGIHQLLAEGVLSAAFPLHDGPFKTPPEGPQAPRLNQRQVLFQHWARWGKWNKYQPLDHVRRYFGEKVALYFAWLGFYTGWLLPAAVVGTLVFLVGCFLVFSDIPTQELCGSKDSFEMCPLCLDCPFWLLSSACALAQAGRLFDHGGTVFFSLFMALWAVLLLEYWKRKSATLAYRWDCSDYEDTEERPRPQFAASAPMTAPNPITGEDEPYFPERSRARRMLAGSVVIVVMVAVVVMCLVSIILYRAIMAIVVSRSGNTLLAAWASRIASLTGSVVNLVFILILSKIYVSLAHVLTRWEMHRTQTKFEDAFTLKVFIFQFVNFYSSPVYIAFFKGRFVGYPGNYHTLFGVRNEECAAGGCLIELAQELLVIMVGKQVINNMQEVLIPKLKGWWQKFRLRSKKRKAGASAGASQGPWEDDYELVPCEGLFDEYLEMVLQFGFVTIFVAACPLAPLFALLNNWVEIRLDARKFVCEYRRPVAERAQDIGIWFHILAGLTHLAVISNAFLLAFSSDFLPRAYYRWTRAHDLRGFLNFTLARAPSSFAAAHNRTCRYRAFRDDDGHYSQTYWNLLAIRLAFVIVFEVAEAPAGSPIHGMRPRPCALPNSSTW

SEQ ID NO: 5499 - protein, 185 aa, Homo sapiens
  Payload ID: 1190;
  Gene Symbol: ANO7;
  Gene Name: anoctamin 7;
  ENSP ID: ENSP00000403625
  MOD_RES (1)..(1): Any amino acid
XAGGAFRGLRADGGGEPGRDPLPAVLQFGFVTIFVAACPLAPLFALLNNWVEIRLDARKFVCEYRRPVAERAQDIGIWFHILAGLTHLAVISNAFLLAFSSDFLPRAYYRWTRAHDLRGFLNFTLARAPSSFAAAHNRTCRYRAFRDDDGHYSQTYWNLLAIRLAFVIVFEHVVFSVGRLLDLLV

SEQ ID NO: 5500 - protein, 1232 aa, Homo sapiens
  Payload ID: 1191;
  Gene Symbol: ANO8;
  Gene Name: anoctamin 8;
  Uniprot ID:  Q9HCE9;
  ENSP ID: ENSP00000159087
MAEAASGAGGTSLEGERGKRPPPEGEPAAPASGVLDKLFGKRLLQAGRYLVSHKAWMKTVPTENCDVLMTFPDTTDDHTLLWLLNHIRVGIPELIVQVRHHRHTRAYAFFVTATYESLLRGADELGLRKAVKAEFGGGTRGFSCEEDFIYENVESELRFFTSQERQSIIRFWLQNLRAKQGEALHNVRFLEDQPIIPELAARGIIQQVFPVHEQRILNRLMKSWVQAVCENQPLDDICDYFGVKIAMYFAWLGFYTSAMVYPAVFGSVLYTFTEADQTSRDVSCVVFALFNVIWSTLFLEEWKRRGAELAYKWGTLDSPGEAVEEPRPQFRGVRRISPITRAEEFYYPPWKRLLFQLLVSLPLCLACLVCVFLLMLGCFQLQELVLSVKGLPRLARFLPKVMLALLVSVSAEGYKKLAIWLNDMENYRLESAYEKHLIIKVVLFQFVNSYLSLFYIGFYLKDMERLKEMLATLLITRQFLQNVREVLQPHLYRRLGRGELGLRAVWELARALLGLLSLRRPAPRRLEPQADEGGGGGSGGGGRRCLSGGCGAPEEEEEAALVERRRAGEGGEEGDGPPGGKEEDEDDEEEEDEEEEEDEEEGEEGGLLDCGLRLKKVSFAERGAGRRRPGPSPEALLEEGSPTMVEKGLEPGVFTLAEEDDEAEGAPGSPEREPPAILFRRAGGEGRDQGPDGGPDPEPGSNSDSTRRQRRQNRSSWIDPPEEEHSPQLTQAELESCMKKYEDTFQDYQEMFVQFGYVVLFSSAFPLAALCALVNNLIEIRSDAFKLCTGLQRPFGQRVESIGQWQKVMEAMGVLAIVVNCYLIGQCGQLQRLFPWLSPEAAIVSVVVLEHFALLLKYLIHVAIPDIPGWVAEEMAKLEYQRREAFKRHERQAQHRYQQQQRRRREEEERQRHAEHHARREHDSGGREEARAEGSGLDPATSSEKASAKAKGSTAGGHGPERPKRPGSLLAPNNVMKLKQIIPLQGKFLSSGATSSLAAAGAGATTRPPPAQSPTGSDTRLPAFLSFKFLKSPETRRDSERSHSPPKAFHAGKLFPFGGTRAEPGSNGAGGQARPDGTPSSGSSRVQRSGPVDEALAEELEAPRPEEEGSGTALAPVGAPALRTRRSRSPAPPPPMPLPRPPTPPAGCWQWDGPWGCGGEGAAPRQALAAAECPPCAMAGPPPAPQPLPGDASFYSLPPPPLPPTSDPLETPAPSPSPSPSPQAVCWPSGWH

SEQ ID NO: 5501 - protein, 581 aa, Homo sapiens
  Payload ID: 1191;
  Gene Symbol: ANO8;
  Gene Name: anoctamin 8;
  ENSP ID: ENSP00000469751
MAEAASGAGGTSLEGERGKRPPPEGEPAAPASGVLDKLFGKRLLQAGRYLVSHKAWMKTVPTENCDVLMTFPDTTDDHTLLWLLNHIRVGIPELIVQVRHHRHTRAYAFFVTATYESLLRGADELGLRKAVKAEFGGGTRGFSCEEDFIYENVESELRFFTSQERQSIIRFWLQNLRAKQGEALHNVRFLEDQPIIPELAARGIIQQVFPVHEQRILNRLMKSWVQAVCENQPLDDICDYFGVKIAMYFAWLGFYTSAMVYPAVFGSVLYTFTEADQTSRDVSCVVFALFNVIWSTLFLEEWKRRGAELAYKWGTLDSPGEAVEEPRPQFRGVRRISPITRAEEFYYPPWKRLLFQLLVSLPLCLACLVCVFLLMLGCFQLQELVLSVKGLPRLARFLPKVMLALLVSVSAEGYKKLAIWLNDMENYRLESAYEKHLIIKVVLFQFVNSYLSLFYIGFYLKDMERLKELLLVLSLSQSLERQLQAVLVPLAALRFRLLLLSLRGLLLAARAKVRAGGEPVGPRRGGQRGCAGGLARRAEGACAEGIWGRGRPASRCRRLGAHAAQCTDRARGGVETRWACP

SEQ ID NO: 5502 - protein, 581 aa, Homo sapiens; identical to SEQ ID NO: 5501
  Payload ID: 1191;
  Gene Symbol: ANO8;
  Gene Name: anoctamin 8;
  ENSP ID: ENSP00000486865

SEQ ID NO: 5503 - protein, 782 aa, Homo sapiens
  Payload ID: 1192;
  Gene Symbol: ANO9;
  Gene Name: anoctamin 9;
  Uniprot ID:  A1A5B4;
  ENSP ID: ENSP00000332788
MQGEESLRILVEPEGDSFPLMEISTCETEASEQWDYVLVAQRHTQRDPRQARQQQFLEELRRKGFHIKVIRDQKQVFFGIRADNSVFGLYRTLLLEPEGPAPHAELAAPTTIPVTTSLRIRIVNFVVMNNKTSAGETFEDLMKDGVFEARFPLHKGEGRLKKTWARWRHMFREQPVDEIRNYFGEKVALYFVWLGWYTYMLVPAALTGLLVFLSGFSLFEASQISKEICEAHDILMCPLGDHSRRYQRLSETCTFAKLTHLFDNDGTVVFAIFMALWATVFLEIWKRQRARVVLHWDLYVWDEEQEEMALQLINCPDYKLRPYQHSYLRSTVILVLTLLMICLMIGMAHVLVVYRVLASALFSSSAVPFLEEQVTTAVVVTGALVHYVTIIIMTKINRCVALKLCDFEMPRTFSERESRFTIRFFTLQFFTHFSSLIYIAFILGRINGHPGKSTRLAGLWKLEECHASGCMMDLFVQMAIIMGLKQTLSNCVEYLVPWVTHKCRSLRASESGHLPRDPELRDWRRNYLLNPVNTFSLFDEFMEMMIQYGFTTIFVAAFPLAPLLALFSNLVEIRLDAIKMVWLQRRLVPRKAKDIGTWLQVLETIGVLAVIANGMVIAFTSEFIPRVVYKYRYSPCLKEGNSTVDCLKGYVNHSLSVFHTKDFQDPDGIEGSENVTLCRYRDYRNPPDYNFSEQFWFLLAIRLAFVILFEHVALCIKLIAAWFVPDIPQSVKNKVLEVKYQRLREKMWHGRQRLGGVGAGSRPPMPAHPTPASIFSARSTDV

SEQ ID NO: 5504 - protein, 379 aa, Homo sapiens
  Payload ID: 1193;
  Gene Symbol: ANHX;
  Gene Name: anomalous homeobox;
  Uniprot ID:  E9PGG2;
  ENSP ID: ENSP00000409950
MQSFLTLLKEHEDTCAPPAELVTLAGRLCRDFQDDLAQLQPLVTAILDSQLRLHLLDNADVALACARVLDQQEQQQAACRLLEGCQVPGGSQELVQLWNDIHYRLVMRRLGVAALTPVQKFRCRKRNPPPPSLCPEGLKSRNFPREVREKLHNFAVGVNTNPSKAERENLALETSLTPEQVYNWFANYRRRQRALPQHMKPAQQATAEDPGARERGPDLLQPSGNPRVDSGFVDRPQWSEEREEKGPPQSPQTTQGPWEPLALAPDFPADETVSKPLDVSGHPQSVQLEEGLGTSSGRTELRVGSFLVTQPPLQAPEFILTQSPPELAPAPSAFPGPVSAMELSQALPSSQVQCSDSQASGDAFWGARMLLEFSGSSLG

SEQ ID NO: 5505 - protein, 379 aa, Homo sapiens; identical to SEQ ID NO: 5504
  Payload ID: 1193;
  Gene Symbol: ANHX;
  Gene Name: anomalous homeobox;
  Uniprot ID:  E9PGG2;
  ENSP ID: ENSP00000439513

SEQ ID NO: 5506 - protein, 680 aa, Homo sapiens
  Payload ID: 1194;
  Gene Symbol: ANOS1;
  Gene Name: anosmin 1;
  Uniprot ID:  P23352;
  ENSP ID: ENSP00000262648
MVPGVPGAVLTLCLWLAASSGCLAAGPGAAAARRLDESLSAGSVQRARCASRCLSLQITRISAFFQHFQNNGSLVWCQNHKQCSKCLEPCKESGDLRKHQCQSFCEPLFPKKSYECLTSCEFLKYILLVKQGDCPAPEKASGFAAACVESCEVDNECSGVKKCCSNGCGHTCQVPKTLYKGVPLKPRKELRFTELQSGQLEVKWSSKFNISIEPVIYVVQRRWNYGIHPSEDDATHWQTVAQTTDERVQLTDIRPSRWYQFRVAAVNVHGTRGFTAPSKHFRSSKDPSAPPAPANLRLANSTVNSDGSVTVTIVWDLPEEPDIPVHHYKVFWSWMVSSKSLVPTKKKRRKTTDGFQNSVILEKLQPDCDYVVELQAITYWGQTRLKSAKVSLHFTSTHATNNKEQLVKTRKGGIQTQLPFQRRRPTRPLEVGAPFYQDGQLQVKVYWKKTEDPTVNRYHVRWFPEACAHNRTTGSEASSGMTHENYIILQDLSFSCKYKVTVQPIRPKSHSKAEAVFFTTPPCSALKGKSHKPVGCLGEAGHVLSKVLAKPENLSASFIVQDVNITGHFSWKMAKANLYQPMTGFQVTWAEVTTESRQNSLPNSIISQSQILPSDHYVLTVPNLRPSTLYRLEVQVLTPGGEGPATIKTFRTPELPPSSAHRSHLKHRHPHHYKPSPERY

SEQ ID NO: 5507 - protein, 679 aa, Homo sapiens
  Payload ID: 1194;
  Gene Symbol: ANOS1;
  Gene Name: anosmin 1;
  ENSP ID: ENSP00000478734
MVPGVPGAVLTLCLWLAASSGAWRPAPARLCAAAGRVAVCRERPARSCASRCLSLQITRISAFFQHFQNNGSLVWCQNHKQCSKCLEPCKESGDLRKHQCQSFCEPLFPKKSYECLTSCEFLKYILLVKQGDCPAPEKASGFAAACVESCEVDNECSGVKKCCSNGCGHTCQVPKTLYKGVPLKPRKELRFTELQSGQLEVKWSSKFNISIEPVIYVVQRRWNYGIHPSEDDATHWQTVAQTTDERVQLTDIRPSRWYQFRVAAVNVHGTRGFTAPSKHFRSSKDPSAPPAPANLRLANSTVNSDGSVTVTIVWDLPEEPDIPVHHYKVFWSWMVSSKSLVPTKKKRRKTTDGFQNSVILEKLQPDCDYVVELQAITYWGQTRLKSAKVSLHFTSTHATNNKEQLVKTRKGGIQTQLPFQRRRPTRPLEVGAPFYQDGQLQVKVYWKKTEDPTVNRYHVRWFPEACAHNRTTGSEASSGMTHENYIILQDLSFSCKYKVTVQPIRPKSHSKAEAVFFTTPPCSALKGKSHKPVGCLGEAGHVLSKVLAKPENLSASFIVQDVNITGHFSWKMAKANLYQPMTGFQVTWAEVTTESRQNSLPNSIISQSQILPSDHYVLTVPNLRPSTLYRLEVQVLTPGGEGPATIKTFRTPELPPSSAHRSHLKHRHPHHYKPSPERY

SEQ ID NO: 5508 - protein, 258 aa, Homo sapiens [sequence omitted]

SEQ ID NO: 5509 - protein, 98 aa, Homo sapiens
  Payload ID: 1195;
  Gene Symbol: AMN1;
  Gene Name: antagonist of mitotic exit network 1 homolog;
  ENSP ID: ENSP00000396145
MKNISRYLTDIKPLPPNIKDRLIKIMSMQGQITDSNISEGHAPLPRLEYSGAISAHCNLRCLDLETGFHHVAQAGLELRSSSDPSASASQNAGITDFT

SEQ ID NO: 5510 - protein, 216 aa, Homo sapiens
  Payload ID: 1195;
  Gene Symbol: AMN1;
  Gene Name: antagonist of mitotic exit network 1 homolog;
  ENSP ID: ENSP00000438990
MKNISRYLTDIKPLPPNIKDRLIKIMSMQGQITDSNISEILHPEVQTLDLRSCDISDAALLHLSNCRKLKKLNLNASKGNRVSVTSEGIKAVASSCSYLHEASLKRCCNLTDEGVVALALNCQLLKIIDLGGCLSITDVSLHALGKNCPFLQCVDFSATQVSDSGVIALVSGPCAKKLEEIHMGHCVNLTDGAVEAVLTYCPQIRILLFHGCPLIT

SEQ ID NO: 5511 - protein, 58 aa, Homo sapiens
  Payload ID: 1195;
  Gene Symbol: AMN1;
  Gene Name: antagonist of mitotic exit network 1 homolog;
  ENSP ID: ENSP00000439171
MGHCVNLTDGAVEAVLTYCPQIRILLFHGCPLITDHSREVLEQLVGPNKLKQVTWTVY

SEQ ID NO: 5512 - protein, 105 aa, Homo sapiens
  Payload ID: 1195;
  Gene Symbol: AMN1;
  Gene Name: antagonist of mitotic exit network 1 homolog;
  ENSP ID: ENSP00000439438
MKNISRYLTDIKPLPPNIKDRLIKIMSMQGQITDSNISEGHAPLPRLEYSGAISAHCNLRCLDLVQTLDLRSCDISDAALLHLSNCRKLKKLNLNASKGNRVSVT

SEQ ID NO: 5513 - protein, 240 aa, Homo sapiens
  Payload ID: 1195;
  Gene Symbol: AMN1;
  Gene Name: antagonist of mitotic exit network 1 homolog;
  Uniprot ID:  Q8IY45;
  ENSP ID: ENSP00000440967
MKNISRYLTDIKPLPPNIKDRLIKIMSMQGQITDSNISEILHPEVQTLDLRSCDISDAALLHLSNCRKLKKLNLNASKGNRVSVTSEGIKAVASSCSYLHEASLKRCCNLTDEGVVALALNCQLLKIIDLGGCLSITDVSLHALGKNCPFLQCVDFSATQVSDSGVIALVSGPCAKKLEEIHMGHCVNLTDGAVEAVLTYCPQIRILLFHGCPLITDHSREVLEQLVGPNKLKQVTWTVY

SEQ ID NO: 5514 - protein, 240 aa, Homo sapiens; identical to SEQ ID NO: 5513
  Payload ID: 1195;
  Gene Symbol: AMN1;
  Gene Name: antagonist of mitotic exit network 1 homolog;
  Uniprot ID:  Q8IY45;
  ENSP ID: ENSP00000441419

SEQ ID NO: 5515 - protein, 87 aa, Homo sapiens
  Payload ID: 1195;
  Gene Symbol: AMN1;
  Gene Name: antagonist of mitotic exit network 1 homolog;
  ENSP ID: ENSP00000441846
MKNISRYLTDIKPLPPNIKDRLIKIMSMQGQITDSNISEILHPEVQTLDLRSCDISDAALLHLSNCRKLKKLNLNASKGNRVSVTSE

SEQ ID NO: 5516 - protein, 35 aa, Homo sapiens
  Payload ID: 1195;
  Gene Symbol: AMN1;
  Gene Name: antagonist of mitotic exit network 1 homolog;
  ENSP ID: ENSP00000442272
MGHCVNLTDGAVEAVLTYCPQIRILLFHGCPLITG

SEQ ID NO: 5517 - protein, 188 aa, Homo sapiens
  Payload ID: 1196;
  Gene Symbol: AGR2;
  Gene Name: anterior gradient 2, prt disulphide isomerase family member;
  ENSP ID: ENSP00000386025
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALCKCDLQFGCCPRVEHLYCCSDGTRGCMVR

SEQ ID NO: 5518 - protein, 175 aa, Homo sapiens
  Payload ID: 1196;
  Gene Symbol: AGR2;
  Gene Name: anterior gradient 2, prt disulphide isomerase family member;
  Uniprot ID:  O95994;
  ENSP ID: ENSP00000391490
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKALKLLKTEL

SEQ ID NO: 5519 - protein, 131 aa, Homo sapiens
  Payload ID: 1196;
  Gene Symbol: AGR2;
  Gene Name: anterior gradient 2, prt disulphide isomerase family member;
  ENSP ID: ENSP00000411969
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFV

SEQ ID NO: 5520 - protein, 119 aa, Homo sapiens
  Payload ID: 1196;
  Gene Symbol: AGR2;
  Gene Name: anterior gradient 2, prt disulphide isomerase family member;
  ENSP ID: ENSP00000414806
PLMIIHHLDECPHSQALKKVFAENKEIQKLAEQFVLLNLVYETTDKHLSPDGQYVPRIMFVDPSLTVRADITGRYSNRLYAYEPADTALCKCDLQFGCCPRVEHLYCCSDGTRGCMVSA

SEQ ID NO: 5521 - protein, 166 aa, Homo sapiens
  Payload ID: 1197;
  Gene Symbol: AGR3;
  Gene Name: anterior gradient 3, prt disulphide isomerase family member;
  Uniprot ID:  Q8TD06;
  ENSP ID: ENSP00000308606
MMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPLLIENMKKALRLIQSEL

SEQ ID NO: 5522 - protein, 163 aa, Homo sapiens
  Payload ID: 1197;
  Gene Symbol: AGR3;
  Gene Name: anterior gradient 3, prt disulphide isomerase family member;
  ENSP ID: ENSP00000386016
MMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPLCKYSQMISNSGHS

SEQ ID NO: 5523 - protein, 129 aa, Homo sapiens
  Payload ID: 1197;
  Gene Symbol: AGR3;
  Gene Name: anterior gradient 3, prt disulphide isomerase family member;
  ENSP ID: ENSP00000392818
  MOD_RES (1)..(1): Any amino acid
XNIQNTFPTRALAKSGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPL

SEQ ID NO: 5524 - protein, 564 aa, Homo sapiens
  Payload ID: 1198;
  Gene Symbol: ANTXR1;
  Gene Name: anthrax toxin receptor 1;
  Uniprot ID:  Q9H6X2;
  ENSP ID: ENSP00000301945
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDGSILAIALLILFLLLALALLWWFWPLCCTVIIKEVPPPPAEESEEEDDDGLPKKKWPTVDASYYGGRGVGGIKRMEVRWGEKGSTEEGAKLEKAKNARVKMPEQEYEFPEPRNLNNNMRRPSSPRKWYSPIKGKLDALWVLLRKGYDRVSVMRPQPGDTGRCINFTRVKNNQPAKYPLNNAYHTSSPPPAPIYTPPPPAPHCPPPPPSAPTPPIPSPPSTLPPPPQAPPPNRAPPPSRPPPRPSV

SEQ ID NO: 5525 - protein, 368 aa, Homo sapiens
  Payload ID: 1198;
  Gene Symbol: ANTXR1;
  Gene Name: anthrax toxin receptor 1;
  Uniprot ID:  Q9H6X2;
  ENSP ID: ENSP00000386494
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDGSILAIALLILFLLLALALLWWFWPLCCTVIIKEVPPPPAEESEENKIK

SEQ ID NO: 5526 - protein, 333 aa, Homo sapiens
  Payload ID: 1198;
  Gene Symbol: ANTXR1;
  Gene Name: anthrax toxin receptor 1;
  Uniprot ID:  Q9H6X2;
  ENSP ID: ENSP00000387058
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSLHKIASGPTTAACME

SEQ ID NO: 5527 - protein, 179 aa, Homo sapiens
  Payload ID: 1198;
  Gene Symbol: ANTXR1;
  Gene Name: anthrax toxin receptor 1;
  ENSP ID: ENSP00000430776
  MOD_RES (1)..(1): Any amino acid
XDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCDGLWFYIQSLETVKDHRNIRVRNSDLKYCL

SEQ ID NO: 5528 - protein, 489 aa, Homo sapiens
  Payload ID: 1199;
  Gene Symbol: ANTXR2;
  Gene Name: anthrax toxin receptor 2;
  Uniprot ID:  P58335;
  ENSP ID: ENSP00000306185
MVAERSPARSPGSWLFPGLWLLVLSGPGGLLRAQEQPSCRRAFDLYFVLDKSGSVANNWIEIYNFVQQLAERFVSPEMRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSILAQSCTEILELQPSSVCVGEEFQIVLSGRGFMLGSRNGSVLCTYTVNETYTTSVKPVSVQLNSMLCPAPILNKAGETLDVSVSFNGGKSVISGSLIVTATECSNGIAAIIVILVLLLLLGIGLMWWFWPLCCKVVIKDPPPPPAPAPKEEEEEPLPTKKWPTVDASYYGGRGVGGIKRMEVRWGDKGSTEEGARLEKAKNAVVKIPEETEEPIRPRPPRPKPTHQPPQTKWYTPIKGRLDALWALLRRQYDRVSLMRPQEGDEVCIWECIEKELTA

SEQ ID NO: 5529 - protein, 386 aa, Homo sapiens
  Payload ID: 1199;
  Gene Symbol: ANTXR2;
  Gene Name: anthrax toxin receptor 2;
  Uniprot ID:  P58335;
  ENSP ID: ENSP00000314883
MVAERSPARSPGSWLFPGLWLLVLSGPGGLLRAQEQPSCRRAFDLYFVLDKSGSVANNWIEIYNFVQQLAERFVSPEMRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSSNGIAAIIVILVLLLLLGIGLMWWFWPLCCKVVIKDPPPPPAPAPKEEEEEPLPTKKWPTVDASYYGGRGVGGIKRMEVRWGDKGSTEEGARLEKAKNAVVKIPEETEEPIRPRPPRPKPTHQPPQTKWYTPIKGRLDALWALLRRQYDRVSLMRPQEGDEVCIWECIEKELTA

SEQ ID NO: 5530 - protein, 411 aa, Homo sapiens
  Payload ID: 1199;
  Gene Symbol: ANTXR2;
  Gene Name: anthrax toxin receptor 2;
  ENSP ID: ENSP00000384028
MRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSILAQSCTEILELQPSSVCVGEEFQIVLSGRGFMLGSRNGSVLCTYTVNETYTTSVKPVSVQLNSMLCPAPILNKAGETLDVSVSFNGGKSVISGSLIVTATECSNGIAAIIVILVLLLLLGIGLMWWFWPLCCKVVIKDPPPPPAPAPKEEEEEPLPTKKWPTVDASYYGGRGVGGIKRMEVRWGDKGSTEEGARLEKAKNAVVKIPEETEEPIRPRPPRPKPTHQPPQTKWYTPIKGRLDALWALLRRQYDRVSLMRPQEGDEGRCINFSRVPSQ

SEQ ID NO: 5531 - protein, 488 aa, Homo sapiens
  Payload ID: 1199;
  Gene Symbol: ANTXR2;
  Gene Name: anthrax toxin receptor 2;
  Uniprot ID:  P58335;
  ENSP ID: ENSP00000385575
MVAERSPARSPGSWLFPGLWLLVLSGPGGLLRAQEQPSCRRAFDLYFVLDKSGSVANNWIEIYNFVQQLAERFVSPEMRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSILAQSCTEILELQPSSVCVGEEFQIVLSGRGFMLGSRNGSVLCTYTVNETYTTSVKPVSVQLNSMLCPAPILNKAGETLDVSVSFNGGKSVISGSLIVTATECSNGIAAIIVILVLLLLLGIGLMWWFWPLCCKVVIKDPPPPPAPAPKEEEEEPLPTKKWPTVDASYYGGRGVGGIKRMEVRWGDKGSTEEGARLEKAKNAVVKIPEETEEPIRPRPPRPKPTHQPPQTKWYTPIKGRLDALWALLRRQYDRVSLMRPQEGDEGRCINFSRVPSQ

SEQ ID NO: 5532 - protein, 245 aa, Homo sapiens
  Payload ID: 1199;
  Gene Symbol: ANTXR2;
  Gene Name: anthrax toxin receptor 2;
  ENSP ID: ENSP00000413700
MRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSILAQSCTEILELQPSSVCVGEEFQIVLSGRGFMLGSRNGSVLCTYTVNETYTTSVKPVSVQLNSMLCPAPILNKAGEWGLTVTQAGVKWHDLTHCTFGLSGSGDPPTSAS

SEQ ID NO: 5533 - protein, 112 aa, Homo sapiens
  Payload ID: 1200;
  Gene Symbol: ANTXRL;
  Gene Name: anthrax toxin receptor-like;
  ENSP ID: ENSP00000479364
  MOD_RES (1)..(1): Any amino acid
XAQKARKLGANVYTLGVADYNLDQITAIADSPGHVFAVENGFKALRSTIDALTSKVCLDVTSVEPSSECVGEPYHVVIHGNGFQNLKKRDEVICRFIFNESTIIGSTLLKSA

SEQ ID NO: 5534 - protein, 565 aa, Homo sapiens [sequence omitted]

SEQ ID NO: 5535 - protein, 61 aa, Homo sapiens
  Payload ID: 1200;
  Gene Symbol: ANTXRL;
  Gene Name: anthrax toxin receptor-like;
  ENSP ID: ENSP00000479836
MWVEETVARFQSPNIRMCFITYSTDGQTVLPLTSDKNRIKNGLDQLQKIVPDGHTFMQAGF

SEQ ID NO: 5536 - protein, 631 aa, Homo sapiens
  Payload ID: 1200;
  Gene Symbol: ANTXRL;
  Gene Name: anthrax toxin receptor-like;
  Uniprot ID:  A6NF34;
  ENSP ID: ENSP00000480615
MGSHESLGPYFLVFLLLLLLPPPLFRAGSLRYHGPDWRIFHRLALGSRRAHHHHGPGWRQHWRQGQAGHRCQGSFDLYFILDKSGSVNNNWIDLYMWVEETVARFQSPNIRMCFITYSTDGQTVLPLTSDKNRIKNGLDQLQKIVPDGHTFMQAGFRKAIQQIESFNSGNKVPSMIIAMTDGELVAHAFQDTLREAQKARKLGANVYTLGVADYNLDQITAIADSPGHVFAVENGFKALRSTIDALTSKVCLDVTSVEPSSECVGEPYHVVIHGNGFQNLKKRDEVICRFIFNESTIIDEKPTSIDNNSMNCPGPKLEKPGEEYSIEVSLNKGKTFFKSNVSITSTTCGIFRNWLYFVPLLLLVPLLLCCVWRLCRKQTVKEPPPVQKPEKEPEQEKPPSPPPPPPPPPPPLPPPPPAPVNTCPTVIICCCGCQGVGGMRRIEGNLDTFCDLSHASCHQVPWMCCQSRDQGRYLSLALAQSQYAQAPCCPRICFPHSQECLSLPQAPCSPRMCLRHSRECLALKQARCSPNICLRHSQHSRECLARKQAPCSPRICLRHSPEYFSQAQTLCNPKSCLQPSRECLPLTCSSRCRLPPARCLRPPSRMLPLLSPLLRHTAEPPLSLPPSEPNF

SEQ ID NO: 5537 - protein, 257 aa, Homo sapiens
  Payload ID: 1200;
  Gene Symbol: ANTXRL;
  Gene Name: anthrax toxin receptor-like;
  ENSP ID: ENSP00000481410
MWVEETVARFQSPNIRMCFITYSTDGQTVLPLTSDKNRIKNGLDQLQKIVPDGHTFMQAGFRKAIQQIESFNSGNKVPSMIIAMTDGELVAHAFQDTLREAQKARKLGANVYTLGVADYNLDQITAIADSPGHVFAVENGFKALRSTIDALTSKVCLDVTSVEPSSECVGEPYHVVIHGNGFQNLKKRDEVICRFIFNESTIIDEKPTSIDNNSMNCPGPKLEKPGEEYSIEVSLNKGKTFFKSNVSITSTTCPSLK

SEQ ID NO: 5538 - protein, 738 aa, Homo sapiens
  Payload ID: 1201;
  Gene Symbol: MFI2;
  Gene Name: antigen p97 (melanoma associated) identified by monoclonal antibodies 133.2 and 96.5;
  Uniprot ID:  P08582;
  ENSP ID: ENSP00000296350
MRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRGDSSGEGVCDKSPLERYYDYSGAFRCLAEGAGDVAFVKHSTVLENTDGKTLPSWGQALLSQDFELLCRDGSRADVTEWRQCHLARVPAHAVVVRADTDGGLIFRLLNEGQRLFSHEGSSFQMFSSEAYGQKDLLFKDSTSELVPIATQTYEAWLGHEYLHAMKGLLCDPNRLPPYLRWCVLSTPEIQKCGDMAVAFRRQRLKPEIQCVSAKSPQHCMERIQAEQVDAVTLSGEDIYTAGKTYGLVPAAGEHYAPEDSSNSYYVVAVVRRDSSHAFTLDELRGKRSCHAGFGSPAGWDVPVGALIQRGFIRPKDCDVLTAVSEFFNASCVPVNNPKNYPSSLCALCVGDEQGRNKCVGNSQERYYGYRGAFRCLVENAGDVAFVRHTTVFDNTNGHNSEPWAAELRSEDYELLCPNGARAEVSQFAACNLAQIPPHAVMVRPDTNIFTVYGLLDKAQDLFGDDHNKNGFKMFDSSNYHGQDLLFKDATVRAVPVGEKTTYRGWLGLDYVAALEGMSSQQCSGAAAPAPGAPLLPLLLPALAARLLPPAL
